(12) United States Patent
Ross et al.

(10) Patent No.: US 7,544,777 B2
(45) Date of Patent: Jun. 9, 2009

(54) PORPHORYMONAS GINGIVALIS POLYPEPTIDES AND NUCLEOTIDES

(75) Inventors: Bruce C. Ross, Victoria (AU); Ian G. Barr, Victoria (AU); Michelle A. Patterson, Victoria (AU); Catherine T. Agius, Victoria (AU); Linda J. Rothel, Victoria (AU); Mai B. Margetts, Victoria (AU); Dianna M. Hocking, Victoria (AU); Elizabeth A. Webb, Victoria (AU)

(73) Assignee: CSL Limited, A.C.N., Victoria (AU)

( * ) Notice: Subject to any disclaimer, the term of this patent is extended or adjusted under 35 U.S.C. 154(b) by 0 days.

(21) Appl. No.: 11/589,261

(22) Filed: Oct. 30, 2006

(65) Prior Publication Data

US 2007/0189981 A1  Aug. 16, 2007

Related U.S. Application Data

(63) Continuation of application No. 09/581,286, filed as application No. PCT/AU98/01023 on Dec. 10, 1998, now abandoned.

(30) Foreign Application Priority Data

Dec. 10, 1997  (AU)  ..................... PP0839

(51) Int. Cl.
  *A61K 38/16* (2006.01)
  *A61K 39/395* (2006.01)
  *C12N 15/31* (2006.01)
(52) U.S. Cl. .................. 530/350; 424/278.1
(58) Field of Classification Search .......... None
  See application file for complete search history.

(56) References Cited

FOREIGN PATENT DOCUMENTS

EP      0 726 314 A     8/1996
WO      WO 96/17936     6/1996

OTHER PUBLICATIONS

Scolnick et al; Trends in Biotech; 18(1), pp. 34-39, 2000.
Database EMBL (online) Oct. 8, 1999; "Complete ORF22 sequence from Neisseria Meningitidis strain A"; retrieved from EBI Database Accession No. AAZ12027 & WO99/24578 (D6).
Chen, H.A., et al; "Immunodominant Antigens of *Porphyromonas gingivalis* in Patient with Rapidly Progressive Periodontitis"; *Oral Microbial Immunol*; vol. 10; pp. 193-201 (1995).
Database Uniprot Online; "48 kDa Outer Membrane Protein"; Database Accession No. Q44130; XP-002302627.
Database Uniprot Online, "Na(+)-translocating NADH-quinone reductase subunit A (EC 1.6.5.-) (Na(+)-translocating NQR su (Na(+)-NQR subunit A) (NQR complex subunit A) NQR-I subunit A)"; Database Accession No. P43955; XP-002302628.

*Primary Examiner*—Michael Borin
(74) *Attorney, Agent, or Firm*—Nixon & Vanderhye PC

(57) ABSTRACT

The present invention relates to isolated *Porphorymonas gingivalis* polypeptides and nucleotides. The polypeptides include;
  an amino acid sequence selected from the group consisting of SEQ. ID. NO. 265 to SEQ. ID. NO. 528, SEQ. ID. NO. 531 and SEQ. ID. NO. 532; or
  an amino acid sequence at least 85%, preferably at least 95%, identical to an amino acid sequence selected from the group consisting of SEQ. ID. NO. 265 to SEQ. ID. NO. 528, SEQ. ID. NO. 531 and SEQ. ID. NO. 532; or
  at least 40 amino acids having a contiguous sequence of at least 40 amino acids identical to a contiguous amino acid sequence selected from the group consisting of SEQ. ID. NO. 265 to SEQ. ID. NO. 528, SEQ. ID. NO. 531 and SEQ. ID. NO. 532.

3 Claims, 2 Drawing Sheets

PORPHORYMONAS GINGIVALIS POLYPEPTIDES AND NUCLEOTIDES

CROSS-REFERENCE TO RELATED APPLICATIONS

This application is a continuation of application Ser. No. 09/581,286, filed Jun. 28, 2000 now abandoned, which is a 317 of PCT/AU98/01023 filed Dec. 10, 1998, the entire content of which is hereby incorporated by reference in this application.

FIELD OF THE INVENTION

The present invention relates to *P. gingivalis* nucleotide sequences, *P. gingivalis* polypeptides and probes for detection of *P. gingivalis*. The *P. gingivalis* polypeptides and nucleotides can be used in compositions for use in raising an immune response in a subject against *P. gingivalis* and treating or preventing or reducing the severity of the condition known as periodontitis.

BACKGROUND OF THE INVENTION

Periodontal diseases are bacterial-associated inflammatory diseases of the supporting tissues of the teeth and range from the relatively mild form of gingivitis, the non-specific, reversible inflammation of gingival tissue to the more aggressive forms of periodontitis which are characterised by the destruction of the tooth's supporting structures. Periodontitis is associated with a subgingival infection of a consortium of specific Gram-negative bacteria that leads to the destruction of the periodontium and is a major public health problem. One bacterium that has attracted considerable interest is *P. gingivalis* as the recovery of this microorganism from adult periodontitis lesions can be up to 50% of the subgingival anaerobically cultivable flora, whereas *P. gingivalis* is rarely recovered, and then in low numbers, from healthy sites. A proportional increase in the level of *P. gingivalis* in subgingival plaque has been associated with an increased severity of periodontitis and eradication of the microorganism from the cultivable subgingival microbial population is accompanied by resolution of the disease. The progression of periodontitis lesions in non-human primates has been demonstrated with the subgingival implantation of *P. gingivalis*. These findings in both animals and humans suggest a major role for *P. gingivalis* in the development of adult periodontitis.

*P. gingivalis* is a black-pigmented, anaerobic, asaccharolytic, proteolytic Gram-negative rod that obtains energy from the metabolism of specific amino acids. The microorganism has an absolute growth requirement for iron, preferentially in the form of haeme or its Fe(III) oxidation product haemin and when grown under conditions of excess haemin is highly virulent in experimental animals. A number of virulence factors have been implicated in the pathogenicity of *P. gingivalis* including the capsule, adhesins, cytotoxins and extracellular hydrolytic enzymes.

In order to develop an efficacious and safe vaccine to prevent, eliminate or reduce *P. gingivalis* colonisation it is necessary to identify and produce antigens that are involved in virulence that have utility as immunogens possibly through the generation of specific antibodies. Whilst it is possible to attempt to isolate antigens directly from cultures of *P. gingivalis* this is often difficult. For example as mentioned above, *P. gingivalis* is a strict anaerobe and can be difficult to isolate and grow. It is also known that, for a number of organisms, when cultured in vitro that many virulence genes are down regulated and the encoded proteins are no longer expressed. If conventional chemistry techniques were applied to purify vaccine candidates potentially important (protective) molecules may not be identified. With DNA sequencing, as the gene is present (but not transcribed) even when the organism is grown in vitro it can be identified, cloned and produced as a recombinant DNA protein. Similarly, a protective antigen or therapeutic target may be transiently expressed by the organism in vitro or produced in low levels making the identification of these molecules extremely difficult by conventional methods.

With serological identification of therapeutic targets one is limited to those responses which are detectable using standard methods such as Western Blotting or ELISA. The limitation here is the both the level of response that is generated by the animal or human and determining whether this response is protective, damaging or irrelevant. No such limitation is present with a sequencing approach to the identification of potential therapeutic or prophylactic targets.

It is also well known that *P. gingivalis* produces a range of broadly active proteases (University of Melbourne International Patent Application No PCT/AU96/00673, U.S. Pat. Nos. 5,475,097 and 5,523,390), which make the identification of intact proteins difficult because of their degradation by these proteases.

SUMMARY OF THE INVENTION

The present inventors have attempted to isolate *P. gingivalis* nucleotide sequences which can be used for recombinant production of *P. gingivalis* polypeptides and to develop nucleotide probes specific for *P. gingivalis*. The DNA sequences listed below have been selected from a large number of *P. gingivalis* sequences according to their indicative potential as vaccine candidates. This intuitive step involved comparison of the deduced protein sequence from the *P. gingivalis* DNA sequences to the known protein sequence databases. Some of the characteristics used to select useful vaccine candidates include; the expected cellular location, such as outer membrane proteins or secreted proteins, particular functional activities of similar proteins such as those with an enzymatic or proteolytic activity, proteins involved in essential metabolic pathways that when inactivated or blocked may be deleterious or lethal to the organism, proteins that might be expected to play a role in the pathogenesis of the organism e.g. red cell lysis, cell agglutination or cell receptors and proteins which are paralogues to proteins with proven vaccine efficacy.

In a first aspect the present invention consists an isolated antigenic *Porphorymonas gingivalis* polypeptide, the polypeptide comprising;

an amino acid sequence selected from the group consisting of SEQ. ID. NO. 265 to SEQ. ID. NO. 528, SEQ. ID. NO. 531 and SEQ. ID. NO. 532; or an amino acid sequence at least 85%, preferably at least 95%, identical to an amino acid sequence selected from the group consisting of SEQ. ID. NO. 265 to SEQ. ID. NO. 528, SEQ. ID. NO. 531 and SEQ. ID. NO. 532; or at least 40 amino acids having a contiguous sequence of at least 40 amino acids identical to a contiguous amino acid sequence selected from the group consisting of SEQ. ID. NO. 265 to SEQ. ID. NO. 528, SEQ. ID. NO. 531 and SEQ. ID. NO. 532.

In an embodiment of the present invention the polypeptide comprises;
an amino acid sequence selected from the group consisting of SEQ. ID. NO. 386 to SEQ. ID. NO. 528 and SEQ. ID. NO. 532; or
an amino acid sequence at least 85%, preferably at least 95%, identical to an amino acid sequence selected from the group consisting of SEQ. ID. NO. 386 to SEQ. ID. NO. 528 and SEQ. ID. NO. 532; or
at least 40 amino acids having a contiguous sequence of at least 40 amino acids identical to a contiguous amino acid sequence selected from the group consisting of SEQ. ID. NO. 386 to SEQ. ID. NO. 528 and SEQ. ID. NO. 532.

As used herein % identity for polypeptides is to be calculated using the alignment algorithm of Needleman and Munsch (9) using a standard protein lo scoring matrix (Blosum 50).

In a preferred embodiment of the present invention the polypeptide comprises an amino acid sequence selected from the group consisting of SEQ. ID. NO. 386, SEQ. ID. NO. 424, SEQ. ID. NO. 425, SEQ. ID. NO. 434, SEQ. ID. NO. 447, SEQ. ID. NO. 458, SEQ. ID. NO. 475, SEQ. ID. NO. 498, SEQ. ID. NO. 499, SEQ. ID. NO. 500, SEQ. ID. NO. 501, SEQ. ID. NO. 387, SEQ. ID. NO. 400, SEQ. ID. NO. 411, SEQ. ID. NO. 419, SEQ. ID. NO. 420, SEQ. ID. NO. 427, SEQ. ID. NO. 429, SEQ. ID. NO. 433, SEQ. ID. NO. 437, SEQ. ID. NO. 438, SEQ. ID. NO. 443, SEQ. ID. NO. 444, SEQ. ID. NO. 448, SEQ. ID. NO. 449, SEQ. ID. NO. 452, SEQ. ID. NO. 455, SEQ. ID. NO. 457, SEQ. ID. NO. 459, SEQ. ID. NO. 461, SEQ. ID. NO. 462, SEQ. ID. NO. 463, SEQ. ID. NO. 467, SEQ. ID. NO. 468, SEQ. ID. NO. 469, SEQ. ID. NO. 482, SEQ. ID. NO. 484, SEQ. ID. NO. 485, SEQ. ID. NO. 494, SEQ. ID. NO. 508, SEQ. ID. NO. 509, SEQ. ID. NO. 510, SEQ. ID. NO. 520, SEQ. ID. NO. 521, SEQ. ID. NO. 522, SEQ. ID. NO. 525, SEQ. ID. NO. 526, SEQ. ID. NO. 528, SEQ. ID. NO. 389, SEQ. ID. NO. 390 and SEQ. ID. NO. 391.

In another preferred embodiment of the present invention the polypeptide comprises an amino acid sequence selected from the group consisting of residue 422 to residue 531 of SEQ. ID. NO. 303, residue 534 to residue 582 of SEQ. ID. NO. 303, residue 127 to residue 232 of SEQ. ID. NO. 301, residue 240 to residue 259 of SEQ. ID. NO. 301, residue 139 to residue 156 of SEQ. ID. NO. 295, residue 160 to residue 178 of SEQ. ID. NO. 295, residue 180 to residue 207 of SEQ. ID. NO. 295, residue 221 to residue 257 of SEQ. ID. NO. 295, residue 259 to residue 323 of SEQ. ID. NO. 295, residue 885 to residue 985 of SEQ. ID. NO. 299, residue 147 to residue 259 of SEQ. ID. NO. 363, residue 140 to residue 252 of SEQ. ID. NO. 344, residue 247 to residue 356 of SEQ. ID. NO. 353, residue 359 to residue 391 of SEQ. ID. NO. 353, residue 120 to residue 254 of SEQ. ID. NO. 300, residue 287 to residue 311 of SEQ. ID. NO. 286, residue 313 to residue 352 of SEQ. ID. NO. 286, residue 354 to residue 401 of SEQ. ID. NO. 286, residue 208 to residue 252 of SEQ. ID. NO. 287, residue 259 to residue 373 of SEQ. ID. NO. 287, residue 5 to residue 120 of SEQ. ID. NO. 293, residue 123 to residue 139 of SEQ. ID. NO. 293, residue 233 to residue 339 of SEQ. ID. NO. 265, residue 67 to residue 228 of SEQ. ID. NO. 278, residue 130 to residue 172 of SEQ. ID. NO. 274, residue 174 to residue 238 of SEQ. ID. NO. 274, residue 99 to residue 112 of SEQ. ID. NO. 274, residue 114 to residue 128 of SEQ. ID. NO. 274, residue 26 to residue 69 of SEQ. ID. NO. 285, residue 71 to residue 128 of SEQ. ID. NO. 285, residue 130 to residue 146 of SEQ. ID. NO. 285, residue 620 to residue 636 of SEQ. ID. NO. 327, residue 638 to residue 775 of SEQ. ID. NO. 327, residue 397 to residue 505 of SEQ. ID. NO. 301, residue 528 to residue 545 of SEQ. ID. NO. 301, residue 556 to residue 612 of SEQ. ID. NO. 301, residue 614 to residue 631 of SEQ. ID. NO. 301, residue 633 to residue 650 of SEQ. ID. NO. 301, residue 553 to residue 687 of SEQ. ID. NO. 299, residue 305 to residue 447 of SEQ. ID. NO. 289, residue 1 to residue 52 of SEQ. ID. NO. 364, residue 65 to residue 74 of SEQ. ID. NO. 364, residue 486 to residue 604 of SEQ. ID. NO. 275, residue 158 to residue 267 of SEQ. ID. NO. 272, residue 270 to residue 282 of SEQ. ID. NO. 272, residue 163 to residue 237 of SEQ. ID. NO. 273, residue 240 to residue 251 of SEQ. ID. NO. 273, residue 213 to residue 344 of SEQ. ID. NO. 282, residue 183 to residue 324 of SEQ. ID. NO. 292, residue 327 to residue 341 of SEQ. ID. NO. 292, residue 352 to residue 372 of SEQ. ID. NO. 292, residue 141 to residue 166 of SEQ. ID. NO. 271, residue 168 to residue 232 of SEQ. ID. NO. 271, residue 1 to residue 13 of SEQ. ID. NO. 302, residue 15 to residue 28 of SEQ. ID. NO. 302, residue 30 to residue 72 of SEQ. ID. NO. 302, residue 476 to residue 529 of SEQ. ID. NO. 277, residue 41 to residue 146 of SEQ. ID. NO. 299, residue 149 to residue 162 of SEQ. ID. NO. 299, residue 166 to residue 177 of SEQ. ID. NO. 299, residue 192 to residue 203 of SEQ. ID. NO. 299, residue 71 to residue 343 of SEQ. ID. NO. 290, residue 346 to residue 363 of SEQ. ID. NO. 290, residue 36 to residue 240 of SEQ. ID. NO. 331, residue 242 to residue 270 of SEQ. ID. NO. 331, residue 1 to residue 192 of SEQ. ID. NO. 375, residue 266 to residue 290 of SEQ. ID. NO. 375, residue 23 to residue 216 of SEQ. ID. NO. 279, residue 220 to residue 270 of SEQ. ID. NO. 279, residue 285 to residue 386 of SEQ. ID. NO. 279, residue 84 to residue 234 of SEQ. ID. NO. 297, residue 248 to residue 259 of SEQ. ID. NO. 297, residue 261 to residue 269 of SEQ. ID. NO. 297, residue 275 to residue 402 of SEQ. ID. NO. 294, residue 1 to residue 171 of SEQ. ID. NO. 298, residue 403 to residue 417 of SEQ. ID. NO. 307, residue 420 to residue 453 of SEQ. ID. NO. 307, residue 456 to residue 464 of SEQ. ID. NO. 307, residue 468 to residue 690 of SEQ. ID. NO. 307, residue 1 to residue 285 of SEQ. ID. NO. 304, residue 287 to residue 315 of SEQ. ID. NO. 304, residue 318 to residue 336 of SEQ. ID. NO. 304, residue 255 to residue 269 of SEQ. ID. NO. 342, residue 271 to residue 337 of SEQ. ID. NO. 342, residue 347 to residue 467 of SEQ. ID. NO. 281, residue 116 to residue 136 of SEQ. ID. NO. 375, residue 138 to residue 357 of SEQ. ID. NO. 375, residue 133 to residue 423 of SEQ. ID. NO. 364, residue 141 to residue 299 of SEQ. ID. NO. 305, residue 202 to residue 365 of SEQ. ID. NO. 296, residue 134 to residue 426 of SEQ. ID. NO. 288, residue 1 to residue 218 of SEQ. ID. NO. 276, residue 1 to residue 246 of SEQ. ID. NO. 280, residue 444 to residue 608 of SEQ. ID. NO. 364, residue lo to residue 686 of SEQ. ID. NO. 283, residue 1 to residue 148 of SEQ. ID. NO. 296, residue 1 to residue 191 of SEQ. ID. NO. 287, residue 193 to residue 204 of SEQ. ID. NO. 287, residue 209 to residue 373 of SEQ. ID. NO. 287, residue 211 to residue 470 of SEQ. ID. NO. 284, residue 472 to residue 482 of SEQ. ID. NO. 284, residue 133 to residue 144 of SEQ. ID. NO. 281, residue 146 to residue 336 of SEQ. ID. NO. 281, residue 1 to residue 264 of SEQ. ID. NO. 303, residue 265 to residue 295 of SEQ. ID. NO. 303, residue 297 to residue 326 of SEQ. ID. NO. 303, residue 328 to residue 338 of SEQ. ID. NO. 303, residue 247 to residue 356 of SEQ. ID. NO. 353, residue 358 to residue 391 of SEQ. ID. NO. 353, residue 257 to residue 288 of SEQ. ID. NO. 298, residue 290 to residue 385 of SEQ. ID. NO. 298, residue 245 to residue 256 of SEQ. ID. NO. 298, residue 422 to residue 802 of SEQ. ID. NO. 303, residue 803 to residue 814 of SEQ. ID. NO. 303, residue 139 to residue 156 of SEQ. ID. NO. 295, residue 160 to residue 340 of SEQ. ID. NO. 295, residue 145 to residue 361 of SEQ. ID. NO. 282, residue 363 to residue 387 of SEQ. ID. NO. 282, residue 398 to residue 471 of SEQ. ID. NO. 282, residue 573 to residue 679 of SEQ. ID. NO. 320, residue 27 to residue 168 of SEQ. ID. NO. 291, residue 170 to residue 183 of SEQ. ID. NO. 291, residue 185 to residue 415 of SEQ. ID. NO. 291, residue 1 to residue 301 of SEQ. ID. NO. 364, residue 114 to residue 702 of SEQ. ID. NO. 337, residue 377 to residue 412 of SEQ. ID. NO. 321, residue 413 to residue 772 of SEQ. ID. NO. 321, residue 14 to residue 454 of SEQ. ID. NO. 265, residue 129 to residue 614 of SEQ. ID. NO. 268, residue 1 to residue 930 of SEQ. ID. NO. 300, residue 932 to residue 1046 of SEQ. ID. NO. 300, residue 1 to residue 301 of SEQ. ID. NO. 364, residue 1 to residue 42 of SEQ. ID. NO. 381, residue 44 to residue 973 of SEQ. ID. NO. 381, residue 1 to residue 93 of SEQ. ID. NO. 358, residue 95 to residue 179 of SEQ. ID. NO. 358, residue 181 to residue 227 of SEQ. ID. NO. 358, residue 114 to residue 702 of SEQ. ID. NO. 337, residue 1 to residue 659 of SEQ. ID. NO. 355, residue 661 to residue 907 of SEQ. ID. NO. 355, residue 1 to residue 131 of SEQ. ID. NO. 370, residue 133 to residue 601 of SEQ. ID. NO. 370, residue 1 to residue 813 of SEQ. ID. NO. 344, residue 377 to residue 412 of SEQ. ID. NO. 321, residue 413 to residue 772 of SEQ. ID. NO. 321, and residue 189 to residue 614 of SEQ. ID. NO. 364.

In a second aspect the present invention consists in a n isolated antigenic *Porphorymonas gingivalis* polypeptide, the polypeptide comprising an amino acid sequence selected from the group consisting of SEQ. ID. NO. 386 to SEQ. ID. NO. 528 and SEQ. ID. NO. 532 less the leader sequence set out in Table 3.

In a third aspect the present invention consists in an isolated DNA molecule, the DNA molecule comprising a nucleotide sequence which encodes the polypeptide of the first aspect the present invention or a sequence which hybridises thereto under stringent conditions.

It is preferred that the isolated DNA molecule comprises a nucleotide sequence selected from the group consisting of SEQ. ID. NO. 1 to SEQ. ID. NO. 264, SEQ. ID. NO. 529 and SEQ. ID. NO. 530.

In a fourth aspect the present invention consists in a recombinant expression vector comprising the DNA molecule of the second aspect of the present invention operably linked to a transcription regulatory element.

The present invention also provides a cell comprising this recombinant expression vector.

In a further aspect the present invention consists in a method for producing a *P. gingivalis* polypeptide comprising culturing the cell under conditions that permit expression of the polypeptide.

In yet a further aspect the present invention provides a composition for use in raising an immune response directed against *P. gingivalis* in a subject, the composition comprising an effective amount of at least one polypeptide of the first aspect of the present invention, or at least one DNA molecule of the second aspect of the present invention, or both, and a pharmaceutically acceptable carrier. It is preferred that the pharmaceutically acceptable carrier is an adjuvant. In other aspects the present invention provides methods of treating *P. gingivalis* infection in subject comprising the administration of the composition to the subject such that treatment of *P. gingivalis* infection occurs. The treatment may be prophylactic or therapeutic.

In yet another aspect the present invention provides an antibody raised against a polypeptide of the first aspect the invention. The antibody may be polyclonal or monoclonal.

The present invention also provides compositions including these antibodies. It is preferred that these compositions are adapted for oral use and may be, for example, dentifrices, mouthwashes, etc.

In a still further aspect the present invention provides a nucleotide probe comprising at least 18 nucleotides and having a contiguous sequence of at least 18 nucleotides identical to a contiguous nucleotide sequence selected from the group consisting of SEQ. ID. NO. 1 to SEQ. ID. NO. 121, SEQ. ID. NO. 529, and sequences complementary thereto. It is preferred that the probe further comprises a detectable label.

The present invention also provides a method for detecting the presence of *P. gingivalis* nucleic acid in a sample comprising:
(a) contacting a sample with the nucleotide probe under conditions in which a hybrid can form between the probe and a *P. gingivalis* nucleic acid in the sample; and
(b) detecting the hybrid formed in step (a), wherein detection of a hybrid indicates the presence of a *P. gingivalis* nucleic acid in the sample.

DETAILED DESCRIPTION

Definitions

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least 10, 20, 50 70, 80 or 95% dry weight of the purified preparation. Preferably, the preparation contains: sufficient polypeptide to allow protein sequencing; at least 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least 10% and more preferably 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *P. gingivalis* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitrocellulose, glass, nylon membranes, beads, particles and the like. The specificity of hybridization is dependent on conditions such as the base pair composition of the nucleotides, and the temperature and salt concentration of the reaction. These conditions are readily discernible to one of ordinary skill in the art using routine experimentation.

Homologous refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared ×100.

The terms peptides, proteins, and polypeptides are used interchangeably herein.

An "immunogenic component" as used herein is a moiety, such as an *P. gingivalis* polypeptide, analog or fragment thereof, that is capable of eliciting a humoral and/or cellular immune response in a host animal.

An "antigenic component" as used herein is a moiety, such as *P. gingivalis* polypeptide, analog or fragment thereof, that is capable of binding to a specific antibody with sufficiently high affinity to form a detectable antigen-antibody complex.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

A "sample" as used herein refers to a biological sample, such as, for example, tissue or fluid isolated from an individual (including without limitation plasma serum, cerebrospinal fluid, lymph, tears, saliva and tissue sections) or from in vitro cell culture constituents, as well as samples from the environment.

The practice of the invention will employ, unless otherwise indicated, conventional techniques of chemistry, molecular biology, microbiology, recombinant DNA, and immunology well known to those skilled in the art. Such techniques are described and explained throughout the literature in sources such as, J. Perbal, A Practical Guide to Molecular Cloning, John Wiley and Sons (1984), J. Sambrook et al., Molecular Cloning: A Laboratory Manual, Cold Spring Harbour Laboratory Press (1989), T. A. Brown (editor), Essential Molecular Biology: A Practical Approach, Volumes 1 and 2, IRL Press (1991), D. M. Glover and B. D. Hames (editors), DNA Cloning: A Practical Approach, Volumes 1-4, IRL Press (1995 and 1996), and F. M. Ausubel et al. (Editors), Current Protocols in Molecular Biology, Greene Pub. Associates and Wiley-Interscience (1988, including all updates until present). The disclosure of these texts are incorporated herein by reference.

Pharmaceutically Acceptable Carriers

The antibodies, polypeptides and DNA of the present invention can be included in compositions which include a carrier or diluent. These compositions include pharmaceutical compositions where the carrier or diluent will be pharmaceutically acceptable. Pharmaceutically acceptable carriers or diluents include those used in compositions suitable for oral, rectal, nasal, topical (including buccal and sublingual), vaginal, parenteral (including subcutaneous, intramuscular, intravenous, intradermal, intrathecal and epidural) administration. They are non-toxic to recipients at the dosages and concentrations employed. Representative examples of pharmaceutically acceptable carriers or diluents include, but are not limited to; water, isotonic solutions which are preferably buffered at a physiological pH (such as phosphate-buffered saline or Tris-buffered saline) and can also contain one or more of, mannitol, lactose, trehalose, dextrose, glycerol, ethanol or polypeptides (such as human serum albumin). The compositions may conveniently be presented in unit dosage form and may be prepared by any of the methods well known in the art of pharmacy.

As will be well understood by those skilled in the art alterations may be made to the amino acid sequences set out in the Sequence Listings. These alterations may be deletions, insertions, or substitutions of amino acid residues. The altered polypeptides can be either naturally occurring (that is to say, purified or isolated from a natural source) or synthetic (for example, by performing site-directed metagenesis on the encoding DNA). It is intended that such altered polypeptides which have at least 85%, preferably at least 95% identity with the sequences set out in the Sequence Listing are within the scope of the present invention. Antibodies raised against these altered polypeptides will also bind to the polypeptides having one of the sequences set out in the Sequence Listings. The level of % identity is to be calculated as set out above.

Protein sequences are homologous if they are related by divergence from a common ancestor. Consequently, a species homologue of the protein will be the equivalent protein which occurs naturally in another species. Within any one species a homologue may exist as numerous allelic variants, and these will be considered homologues of the protein. Allelic variants and species homologues can be obtained by following standard techniques known to those skilled in the art.

An allelic variant will be a variant that is naturally occurring within an individual organism.

Mutants, Variants and Homology—Nucleic Acids

Mutant polynucleotides will possess one or more mutations which are deletions, insertions, or substitutions of nucleotide residues. Mutants can be either naturally occurring (that is to say, isolated from a natural source) or synthetic (for example, by performing site-directed metagenesis on the DNA). It is thus apparent that polynucleotides of the invention can be either naturally occurring or recombinant (that is to say prepared using recombinant DNA techniques).

An allelic variant will be a variant that is naturally occurring within an individual organism.

Nucleotide sequences are homologous if they are related by divergence from a common ancestor. Consequently, a species homologue of the polynucleotide will be the equivalent polynucleotide which occurs naturally in another species. Within any one species a homologue may exist as numerous allelic variants, and these will be considered homologues of the polynucleotide. Allelic variants and species homologues can be obtained by following standard techniques known to those skilled in the art.

Antibody Production

Antibodies, either polyclonal or monoclonal, which are specific for a polypeptide of the present invention can be produced by a person skilled in the art using standard techniques such as, but not limited to, those described by Harlow et al. Antibodies: A Laboratory Manual, Cold Springs Harbor Laboratory Press (1988), and D. Catty (editor), Antibodies: A Practical Approach, IRL Press (1988).

Various procedures known in the art may be used for the production of polyclonal antibodies to epitopes of a protein. For the production of polyclonal antibodies, a number of host animals are acceptable for the generation of antibodies by immunization with one or more injections of a polypeptide preparation, including but not limited to rabbits, mice, rats, etc. Various adjuvants may be used to increase the immunological response in the host animal, depending on the host species, including but not limited to Freund's (complete and incomplete), mineral gels such as aluminium hydroxide, surface active substances such as lysolecithin, pluronic polyols, polyanions, oil emulsions, keyhole lympet hemocyanins, dinitrophenol, and potentially useful human adjuvants such as BCG (bacille Calmette-Guerin) and *Corynebacterium parvum*.

A monoclonal antibody to an epitope of a protein may be prepared by using any technique which provides for the production of antibody molecules by continuous cell lines in culture. These include but are not limited to the hybridoma technique originally described by Kohler and Milstein (1975, Nature 256, 493-497), and the more recent human B-cell hybridoma technique (Kesber et al. 1983, Immunology Today 4:72) and EBV-hybridoma technique (Cole et al. 1985, Monoclonal Antibodies and Cancer Therapy, Alan R. Liss, Inc. pp. 77-96). In addition, techniques developed for the production of "chimeric antibodies" by splicing the genes from antibody molecule of appropriate antigen specificity together with genes from a human antibody molecule of appropriate biological activity may be used (Morrison et al. 1984, Proc. Natl. Acad. Sci., 81:6851-6855; Neuberger et al. 1984 Nature 312:604-608; Takeda et al. 1985 Nature 31:452-454). Alternatively, techniques described for the production of single chain antibodies (U.S. Pat. No. 4,946,778) can be adapted to produce 4-specific single chain antibodies.

Recombinant human or humanized versions of monoclonal antibodies are a preferred embodiment for human therapeutic applications. Humanized antibodies may be prepared according to procedures in the literature (e.g. Jones et al. 1986, Nature 321:522-25; Reichman et al. 1988 Nature 332:323-27; Verhoeyen et al. 1988, Science 239:1534-36). The recently described "gene conversion metagenesis" strategy for the production of humanized monoclonal antibody may also be employed in the production of humanized antibodies (Carter et al. 1992 Proc. Natl. Acad. Sci. U.S.A. 89:4285-89). Alternatively, techniques for generating the recombinant phase library of random combinations of heavy and light regions may be used to prepare recombinant antibodies (e.g. Huse et al. 1989 Science 246:1275-81).

Antibody fragments which contain the idiotype of the molecule such as Fu F(ab1) and F(ab2) may be generated by known techniques. For example, such fragments include but are not limited to: the F(ab) E2 fragment which can be produced by pepsin digestion of the intact antibody molecule; the Fab' fragments which can be generated by reducing the disulfide bridges of the F(ab')2 fragment, and the two Fab fragments which can be generated by treating the antibody molecule with papain and a reducing agent. Alternatively, Fab expression libraries may be constructed (Huse et al. 1989, Science 246:1275-1281) to allow rapid and easy identification of monoclonal Fab fragment with the desired specificity to a protein.

Adjuvants

"Adjuvant" means a composition comprised of one or more substances that enhances the immunogenicity and efficacy of a vaccine composition. Non-limiting examples of suitable adjuvants include squalane and squalene (or other oils of animal origin); block copolymers; detergents such as Tween®-80; Quil® A, mineral oils such as Drakeol or Marcol, vegetable oils such as peanut oil; *Corynebacterium*-derived adjuvants such as *Corynebacterium parvum; Propionibacterium*-derived adjuvants such as *Propionibacterium acne; Mycobacterium bovis* (*Bacillus* Calmetic and Guerinn or BCG); interleukins such as interleukin 2 and interleukin-12; monokines such as interleukin 1; tumour necrosis factor; interferons such as gamma interferon; combinations such as saponin-aluminium hydroxide or Quil-A aluminium hydroxide; liposomes; ISCOM adjuvant; mycobacterial cell wall extract; synthetic glycopeptides such as muramyl dipeptides or other derivatives; Avridine; Lipid A; dextran sulfate; DEAE-Dextran or DHAE-Dextran with aluminium phosphate; carboxypolymethylene such as Carbopol' EMA; acrylic copolymer emulsions such as Neocryl A640 (e.g. U.S. Pat. No. 5,047,238); vaccinia or animal posvirus proteins; sub-viral particle adjuvants such as cholera toxin, or mixtures thereof.

As used herein, stringent conditions are those that (1) employ low ionic strength and high temperature for washing, for example, 0.015 M NaCl/0.0015 M sodium citrate/0.1% NaDodSO$_4$ at 50° C.; (2) employ during hybridisation a denaturing agent such as formamide, for example, 50% (vol/vol)

formamide with 0.1% bovine serum albumin, 0.1% Ficoll, 0.1% polyvinylpyrrolidone, 50 mM sodium phosphate buffer at pH 6.5 with 750 mM NaCl, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 µg/ml), 0.1% SDS and 10% dextran sulfate at 42° C. in 0.2×SSC and 0.1% SDS As will be understood the present invention includes within its scope DNA vaccination. Further information regarding DNA vaccination may be found in Donnelly et al, Journal of Immunological Methods 176(1994) 145-152, the disclosure of which is incorporated herein by reference.

Throughout this specification the word "comprise", or variations such as "comprises" or "comprising", will be understood to imply the inclusion of a stated element or integer or group of elements or integers but not the exclusion of any other element or integer, or group of elements or integers.

Preparation of the *P. gingivalis* Library for Sequencing.

To determine the DNA sequence of *P. gingivalis* genomic DNA was isolated from *P. gingivalis* strain W50 (ATCC 53978) essentially by the method described by Mamur J. (J. Mol. Biol. 3, 208-218, 1961). Cloning of DNA fragments was performed essentially as described by Fleischmann et al., (Science; 269, 496-512, 1995)(2). Briefly, purified genomic DNA from *P. gingivalis* was nebulized to fragment the DNA and was treated with Bal31 nuclease to create blunt ends then run twice through preparative 1% agarose gels. DNA fragments of 1.6-2.0 kb were excised from the gel and the DNA recovered. This DNA was then ligated to the vector pUC18 (SmaI digested and dephosphorylated; Pharmacia) and electrophoresed through a 1% preparative agarose gel. The fragment comprising linear vector plus one insert was excised, purified and this process repeated to reduce any vector without insert contamination. The recovered vector plus insert DNA was blunt-ended with T4 DNA polymerase, then a final ligation to produce circular DNA was performed. Aliquots of Epicurian Coli Electroporation-Competent Cells (Stratagene) were transformed with the ligated DNA and plated out on SOB agar antibiotic diffusion plates containing X-gal and incubated at 37° C. overnight. Colonies with inserts appeared white and those without inserts (vector alone) appeared blue. Plates were stored at 4° C. until the white clones were picked and expanded for the extraction of plasmid DNA for sequencing.

DNA Sequencing

Plasmid DNA was prepared by picking bacterial colonies into 1.5 ml of LB, TB or SOB broth supplemented with 50-100 ug/ml Ampicillin in 96 deep well plates. Plasmid DNA was isolated using the QIAprep Spin or QIAprep 96 Turbo miniprep kits (QIAGEN GmbH, Germany). DNA was eluted into a 96 well gridded array and stored at −20 C.

Sequencing reactions were performed using ABI PRISM Dye Terminator and ABI PRISM BIGDye Terminator Cycle Sequencing Ready Reaction kits with AmpliTaq DNA polymerase FS (PE Applied Biosystems, Foster City, Calif.) using the M13 Universal forward and reverse sequencing primers. Sequence reactions were conducted on either a Perkin-Elmer GeneAmp 9700 (PE Applied Biosystems) or Hybaid PCR Express (Hybaid, UK) thermal cyclers. Sequencing reactions were analysed on ABI PRISM 377 DNA sequencers (PE Applied Biosystems).

The sequences obtained are set out below. The relationship between these sequences is set out in Table 1. The initiation codon was calculated using a combination of sequence homology alignment (FASTA), signal sequence prediction (PSORT, SignalP) or ORF prediction (GeneMark).

TABLE 1

Reference table indicating the relationships of each sequence ID to the selected proteins.

| Protein name | DNA sequence of complete ORF | Amino acid sequence of complete ORF | DNA sequence of protein | Amino acid sequence of protein |
|---|---|---|---|---|
| PG1 | 1 | 265 | 122 | 386 |
| PG10 | 2 | 266 | 123 | 387 |
| PG100 | 3 | 267 | 124 | 388 |
| PG101 | 4 | 268 | | |
| PG102 | 5 | 269 | 125, 126 | 389, 390 |
| PG104 | 6 | 270 | 127 | 391 |
| PG105 | 7 | 271 | 128 | 392 |
| PG106 | 8 | 272 | 129 | 393 |
| PG107 | 9 | 273 | 130, 131, 132 | 394, 395, 396 |
| PG108 | 10 | 274 | 133 | 397 |
| PG109 | 11 | 275 | 134, 135 | 398, 399 |
| PG11 | 12 | 276 | 136 | 400 |
| PG110 | 13 | 277 | 137 | 401 |
| PG111 | 14 | 278 | | |
| PG112 | 15 | 279 | 138, 139 | 402, 403 |
| PG113 | 16 | 280 | 140 | 404 |
| PG114 | 17 | 281 | 141 | 405 |
| PG115 | 18 | 282 | 142 | 406 |
| PG116 | 19 | 283 | 143 | 407 |
| PG117 | 20 | 284 | 144 | 408 |
| PG118 | 21 | 285 | 145 | 409 |
| PG119 | 22 | 286 | 146 | 410 |
| PG12 | 23 | 287 | 147 | 411 |
| PG120 | 24 | 288 | 148 | 412 |
| PG121 | 25 | 289 | 149 | 413 |
| PG122 | 26 | 290 | 150 | 414 |
| PG123 | 27 | 291 | 151 | 415 |
| PG124 | 28 | 292 | 152 | 416 |
| PG125 | 29 | 293 | 153 | 417 |
| PG126 | 30 | 294 | 154 | 418 |
| PG13 | 31 | 295 | 155 | 419 |
| PG14 | 32 | 296 | 156 | 420 |
| PG15 | 33 | 297 | 157 | 421 |
| PG16 | 34 | 298 | 158 | 422 |
| PG18 | 35 | 299 | 159 | 423 |
| PG2 | 36 | 300 | 160, 161 | 424, 425 |
| PG21 | 37 | 301 | 162 | 426 |
| PG22 | 38 | 302 | 163 | 427 |
| PG23 | 39 | 303 | 164 | 428 |
| PG24 | 40 | 304 | 165 | 429 |
| PG25 | 41 | 305 | 166 | 430 |
| PG27 | 42 | 306 | 167 | 431 |
| PG28 | 43 | 307 | 168 | 432 |
| PG29 | 44 | 308 | 169 | 433 |
| PG3 | 45 | 309 | 170 | 434 |
| PG30 | 46 | 310 | 171 | 435 |
| PG31 | 47 | 311 | 172 | 436 |
| PG32 | 48 | 312 | 173 | 437 |
| PG33 | 49 | 313 | 174 | 438 |
| PG34 | 50 | 314 | 175, 176 | 439, 440 |
| PG35 | 51 | 315 | 177 | 441 |
| PG36 | 52 | 316 | 178 | 442 |
| PG37 | 53 | 317 | 179, 180 | 443, 444 |
| PG38 | 54 | 318 | 181 | 445 |
| PG39 | 55 | 319 | 182 | 446 |
| PG4 | 56 | 320 | 183 | 447 |
| PG40 | 57 | 321 | 184 | 448 |
| PG41 | 58 | 322 | 185 | 449 |
| PG42 | 59 | 323 | 186 | 450 |
| PG43 | 60 | 324 | 187 | 451 |
| PG44 | 61 | 325 | 188 | 452 |
| PG45 | 62 | 326 | 189 | 453 |
| PG46 | 63 | 327 | 190 | 454 |

TABLE 1-continued

Reference table indicating the relationships of each sequence ID to the selected proteins.

| Protein name | DNA sequence of complete ORF | Amino acid sequence of complete ORF | DNA sequence of protein | Amino acid sequence of protein |
|---|---|---|---|---|
| PG47 | 64 | 328 | 191 | 455 |
| PG48 | 65 | 329 | 192 | 456 |
| PG49 | 66 | 330 | 193 | 457 |
| PG5 | 67 | 331 | 194 | 458 |
| PG50 | 68 | 332 | 195 | 459 |
| PG51 | 69 | 333 | 196 | 460 |
| PG52 | 70 | 334 | 197 | 461 |
| PG53 | 71 | 335 | 198 | 462 |
| PG54 | 72 | 336 | 199 | 463 |
| PG55 | 73 | 337 | 200 | 464 |
| PG56 | 74 | 338 | 201, 202 | 465, 466 |
| PG57 | 75 | 339 | 203, 204, 205 | 467, 468, 469 |
| PG58 | 76 | 340 | 206, 207 | 470, 471 |
| PG59 | 77 | 341 | 208, 209, 210 | 472, 473, 474 |
| PG6 | 78 | 342 | 211 | 475 |
| PG60 | 79 | 343 | 212 | 476 |
| PG61 | 80 | 344 | 213 | 477 |
| PG62 | 81 | 345 | 214 | 478 |
| PG63 | 82 | 346 | 215 | 479 |
| PG64 | 83 | 347 | 216 | 480 |
| PG65 | 84 | 348 | 217 | 481 |
| PG66 | 85 | 349 | 218 | 482 |
| PG67 | 86 | 350 | 219 | 483 |
| PG68 | 87 | 351 | 220, 221 | 484, 485 |
| PG69 | 88 | 352 | 222 | 486 |
| PG7 | 89 | 353 | 223 | 487 |
| PG70 | 90 | 354 | 224 | 488 |
| PG71 | 91 | 355 | 225 | 489 |
| PG72 | 92 | 356 | 226 | 490 |
| PG73 | 93 | 357 | 227 | 491 |
| PG74 | 94 | 358 | 228 | 492 |
| PG75 | 95 | 359 | 229 | 493 |
| PG76 | 96 | 360 | 230 | 494 |
| PG77 | 97 | 361 | 231 | 495 |
| PG78 | 98 | 362 | 232 | 496 |
| PG79 | 99 | 363 | 233 | 497 |
| PG8 | 100 | 364 | 234, 235, 236, 237 | 498, 499, 500, 501 |
| PG80 | 101 | 365 | 238 | 502 |
| PG81 | 102 | 366 | 102 | 366 |
| PG82 | 103 | 367 | 239 | 503 |
| PG83 | 104 | 368 | 240 | 504 |
| PG84 | 105 | 369 | 241, 242 | 505, 506 |
| PG85 | 106 | 370 | 243 | 507 |
| PG86 | 107 | 371 | 244, 245 | 508, 509 |
| PG87 | 108 | 372 | 246 | 510 |
| PG88 | 109 | 373 | 247, 248, 249 | 511, 512, 513 |
| PG89 | 110 | 374 | 250 | 514 |
| PG9 | 111 | 375 | 251, 252, 253 | 515, 516, 517 |
| PG90 | 112 | 376 | 254, 255 | 518, 519 |
| PG91 | 113 | 377 | 256 | 520 |
| PG92 | 114 | 378 | 257 | 521 |
| PG93 | 115 | 379 | 258 | 522 |
| PG94 | 116 | 380 | 259 | 523 |
| PG95 | 117 | 381 | 260 | 524 |
| PG96 | 118 | 382 | 261 | 525 |
| PG97 | 119 | 383 | 262 | 526 |
| PG98 | 120 | 384 | 263 | 527 |
| PG99 | 121 | 385 | 264 | 528 |
| PG127 | 529 | 531 | 530 | 532 |

DNA Sequence Analysis

DNA files in FASTA format were converted to GCG format files and imported into a database. The DNA files were translated into amino acid files using the program Flip obtained from ANGIS(Australian Genomic Information Service, University of Sydney, Australia). A series of bioinformatic analyses were performed on the proteins in order to select potential vaccine candidates. The programs used were FASTA homology searching (1), PSORT (2,3), SignalP (4), TopPred (5), and GeneMark (6). The proteins and their bioinformatic results were stored in the custom written database for search and retrieval of proteins with the desired characteristics The FASTA homology results for these proteins were then examined for any alignment with a protein suggesting surface location or vaccine efficacy. All proteins were searched for homology against a non-redundant bacterial protein database compiled by ANGIS using the FASTA algorithm. The settings used for the FASTA searches were Ktup=2, gap creation penalty=−12, gap extension penalty=−2, width for deriving alignment in opt=16 and the Blosum 50 scoring matrix. Individual FASTA search results were examined for significant homology by statistical probability and amino acid alignments. The results are set out in Table 2.

Protein files were then trimmed to the first, second, third, fourth and fifth methionine residues using a protein trimming program (ANGIS). The trimmed proteins were then subjected to PSORT analysis for the detection of signal sequences and the prediction of cell location. Proteins exhibiting a PSORT probability of outer membrane >0.8 were considered to indicate surface localisation. A second signal sequence detection program SignalP was also performed and, in certain instances, this program detected signals not identified with PSORT. All proteins identified by other methods were also analysed by PSORT and SignalP. Previously, the C-terminal amino acid of bacterial outer membrane proteins has been shown to be important for the assembly of the protein on the outer membrane (7). A typical structure definition for outer membrane proteins has been determined as the presence of a signal sequence at the N-terminus and a tyrosine or phenylalanine at the C-terminus. A number of the selected proteins exhibit this characteristic structure. The program TopPred was used to determine the presence and number of membrane spanning domains (MSDs) and the presence of such sequences indicates a preference to be attached to membranes such as the outer membrane. The results of PSORT, SignalP and TopPred analyses with the C-terminal amino acids of the selected proteins are set out in Table 3.

The 70 amino acids from the C-terminus of a number of *P. gingivalis* outer membrane proteins share 50-100% protein sequence identity. These proteins included RGP1, RGP2, KGP, HagA, HagC, HagD, prtH and prtT. This conserved motif may be involved in the attachment or sorting of proteins to the outer membrane. The protein data set was searched using FASTA homology as described above and a number of novel proteins were identified which demonstrate similar motifs at their C-termini. The results are listed in Table 4

The TonBIII box is a 30 amino acid motif present within TonB outer membrane receptors in a wide variety of bacteria. The TonBIII box of *P. gingivalis* (8) was used to search the protein data set for homology by FASTA as described above. Those proteins demonstrating significant homology are listed in Table 5.

TABLE 2

FASTA protein homology results of complete ORFs against a non-redundant protein database.

| Protein name | Homology description | Genbank accession number | Length of homolog | Length of *P. gingivalis* protein | FASTA homology results Identity % | Overlap | E value |
|---|---|---|---|---|---|---|---|
| PG1 | 48 kD outer membrane protein, *Actinobacillus pleuropneumoniae* | U24492 | 449aa | 451aa | 32 | 454aa | 1.40E−42 |
| PG2 | Outer membrane protein (susC), *Bacteroides thetaiotaomicron* | L49338 | 1038aa | 1017aa, 1014aa | 28 | 1099aa | 4.60E−32 |
| PG3 | Outer membrane porin F adhesin, *Pseudomonas fluorescens* | U19743 | 317aa | 223aa | 35 | 187aa | 1.10E−10 |
| PG4 | Outer membrane protein A, *Escherichia fergusonii* | M63352 | 243aa | 672aa | 48 | 88aa | 4.10E−10 |
| PG5 | Adhesin protein (AdcA), *Streptococcus pneumoniae* | Z71552 | 423aa | 315aa | 25 | 279aa | 9.40E−15 |
| PG6 | Hemolysin A (phyA), *Prevotella melaninogenica* | U27587 | 332aa | 324aa | 60 | 306aa | 3.00E−74 |
| PG7 | Hemolysin (tlyC), *Serpulina hyodysenteriae* | X73141 | 268aa | 404aa | 33 | 266aa | 1.40E−24 |
| PG8 | Heme uptake protein A, *Bacteriodes fragilis* | X97122 | 431aa | 598aa, 550aa, 458aa, 426aa | 79 | 417aa | 6.70E−121 |
| PG9 | Internalin A (inlA), *Lysteria monocytogenes* | M67471 | 744aa | 1266aa, 1232aa, 1174aa | 38 | 340aa | 7.30E−23 |
| PG10 | Macrophage infectivity potentiator (MIP), *Legionella oakridgensis*. | U92214 | 234aa | 195aa | 50 | 201aa | 4.70E−31 |
| PG11 | Haemagglutinin (phg), *Prevotella intermedia* | AF017417 | 309aa | 313aa | 44 | 309aa | 3.60E−44 |
| PG12 | Outer membrane lipoprotein, *Haemophilus influenzae* | M68502 | 274aa | 271aa | 36 | 254aa | 9.60E−27 |
| PG13 | Ferric receptor (cfrA), *Campylobacter coli* | U80812 | 696aa | 757aa | 24 | 625aa | 1.20E−18 |
| PG14 | 36 kD antigen, *Helicobacter pylori* | U86610 | 329aa | 331aa | 37 | 326aa | 1.10E−35 |
| PG15 | Outer membrane protein, *Erwinia amylovara* | X77921 | 377aa | 267aa | 30 | 253aa | 5.40E−08 |
| PG16 | C terminal protease, *Bartonella bacilliformis* | L37094 | 434aa | 569aa | 36 | 357aa | 3.00E−35 |
| PG18 | Protein-export membrane protein (secD), *Helicobacter pylori* | AE000652 | 503aa | 981aa | 32 | 611aa | 1.10E−36 |
| PG21 | Surface antigen gene, *Methanosarcina mazei* | X84710 | 783aa | 821aa | 37 | 331aa | 6.20E−33 |
| PG22 | Alpha-hemolysin gene, *Aeromonas hydrophila* | L36462 | 85aa | 106aa | 57 | 67aa | 2.60E−14 |
| PG23 | clpA/clpB protease, *Bacillus subtilis* | D26185 | 810aa | 859aa | 45 | 855aa | 7.10E−122 |
| PG24 | Putative hemolysin, *Streptococcus mutans* | AF051356 | 445aa | 417aa | 29 | 432aa | 1.80E−29 |
| PG25 | Cysteine protease, *Porphyromonas gingivalis* | U54691 | 1723aa | 293aa | 42 | 142aa | 1.10E−12 |
| PG27 | TonB linked adhesin, *Porphyromonas gingivalis* | Y07618 | 1097aa | 312aa | 45 | 360aa | 3.20E−41 |
| PG28 | Cysteine protease/hemagglutinin, *Porphyromonas gingivalis* | S75942 | 886aa | 843aa | 35 | 838aa | 7.00E−90 |
| PG30 | Putative NlpD lipoprotein, *Aquifex aeolicus* | AE000754 | 187aa | 337aa | 42 | 142aa | 1.80E−12 |
| PG31 | Hemolysin (tlyC), *Serpulina hyodysenteriae* | X73141 | 141aa | 151aa | 31 | 123aa | 1.80E−07 |
| PG32 | Major outer membrane protein (oprF), *Pseudomonas aeruginosa* | M94078 | 350aa | 391aa | 26 | 382aa | 3.40E−07 |
| PG33 | Major outer membrane protein (oprF), *Pseudomonas fluorescens* | L21200 | 317aa | 385aa | 32 | 163aa | 2.30E−06 |
| PG34 | Putative membrane protein, *Rhodobacter capsulatus* | Q07396 | 193aa | 190aa | 46 | 190aa | 2.20E−36 |
| PG35 | Colcin 1 receptor, *Escherichia coli* | J04229 | 663aa | 833aa | 25 | 590aa | 2.40E−10 |
| PG36 | Outer membrane antigen (oma87), *Pasteurella multocida* | U60439 | 789aa | 891aa | 21 | 894aa | 3.70E−10 |
| PG37 | Cationic outer membrane protein (ompH), *Yersinia enterocolitica* | M34854 | 164aa | 174aa, 170aa | 27 | 168aa | 4.30E−07 |
| PG38 | Cationic outer membrane protein (ompH), *Yersinia enterocolitica* | M34854 | 164aa | 163aa | 23 | 160aa | 5.90E−05 |
| PG39 | Outer membrane protein (susC) *Bacteroides thetaiotaomicron* | L49338 | 1038aa | 827aa | 24 | 347aa | 1.50E−06 |
| PG40 | Heme receptor (Hut A), *Vibrio cholera* | Q56644 | 693aa | 772aa | 23 | 722aa | 4.90E−09 |
| PG41 | Outer membrane protein (tolC), *Escherichia coli* | X54049 | 495aa | 462aa | 22 | 436aa | 4.60E−09 |
| PG42 | Neuraminidase, *Micromonospora viridifaciens* | D01045 | 647aa | 492aa | 32 | 375aa | 2.10E−22 |
| PG43 | Immunoreactive outer membrane protein (omp28), *Brucella melitensis* | U30815 | 250aa | 245aa | 24 | 178aa | 0.0015 |
| PG44 | Macrophage infectivity potentiator, *Legionella israelensis* | U92208 | 242aa | 276aa | 35 | 219aa | 9.10E−18 |
| PG45 | Outer membrane protein, *Neisseria meningitidis* | AF021245 | 797aa | 775aa | 21 | 699aa | 0.0034 |
| PG46 | Outer membrane protein 85, *Neisseria gonorrhoeae* | UB1959 | 792aa | 774aa | 31 | 117aa | 0.00098 |
| PG47 | Outer membrane protein (susC) *Bacteroides thetaiotaomicron* | L49338 | 1038aa | 867aa | 20 | 962aa | 1.00E−03 |
| PG48 | Immunoglobulin binding surface protein (sir22), *Streptococcus pyogenes* | X75750 | 365aa | 431aa | 25 | 269aa | 5.20E−05 |
| PG49 | Fimbrillin (orf2), *Porphyromonas gingivalis* | D42067 | 453aa | 333aa | 23 | 296aa | 0.062 |
| PG50 | Outer membrane protein (susC) *Bacteroides thetaiotaomicron* | L49338 | 1038aa | 848aa | 26 | 579aa | 1.60E−11 |
| PG51 | PGaA antigen, *Porphyromonas gingivalis* | X95938 | 202aa | 202aa | 54 | 126aa | 1.20E−25 |
| PG52 | Alkaline protease secretion apparatus (aprF) *Pseudomonas aeruginosa* | X64558 | 481aa | 455aa | 21 | 427aa | 3.50E−06 |
| PG53 | Protein export protein (tolC), *Salmonella enteritidis* | U25178 | 491aa | 444aa | 23 | 436aa | 6.20E−11 |
| PG54 | Protease I, *Achromobacter lyticus* | J5128 | 653aa | 940aa | 24 | 695aa | 1.50E−22 |
| PG55 | Fimbrillin (orf3), *Porphyromonas gingivalis* | D42067 | 670aa | 670aa | 43 | 688aa | 4.90E−106 |

TABLE 2-continued

FASTA protein homology results of complete ORFs against a non-redundant protein database.

| Protein name | Homology description | Genbank accession number | Length of homolog | Length of *P. gingivalis* protein | FASTA homology results | | |
|---|---|---|---|---|---|---|---|
| | | | | | Identity % | Overlap | E value |
| PG56 | Cysteine protease *Porphyromonas gingivalis* | U68468 | 364aa | 1282aa, 1274aa | 25 | 212aa | 0.00012 |
| PG57 | Cysteine protease, *Porphyromonas gingivalis* | U68468 | 1358aa | 924aa, 922aa, 921aa | 31 | 742aa | 1.40E−23 |
| PG60 | Outer membrane protein 11, *Helicobacter pylori* | AE000562 | 186aa | 547aa | 25 | 183aa | 2.20E+00 |
| PG61 | Ferric pseudobactin M114 receptor protein (pbuA), *Pseudomonas* sp. | X73412 | 826aa | 749aa | 22 | 585aa | 1.00E−05 |
| PG66 | Attachment and invasion protein (ail), *Salmonella typhimurium* | AF007380 | 165aa | 206aa | 21 | 140aa | 1.90E+00 |
| PG68 | Serum opacity factor, *Streptococcus pyogenes* | U02290 | 1025aa | 1225aa, 1224aa | 24 | 176aa | 2.10E−01 |
| PG69 | Vacuolating cytotoxin (vacA), *Helicobacter pylori* | U63261 | 160aa | 425aa | 32 | 111aa | 1.20E+00 |
| PG70 | Outer membrane protein, *Neisseria gonorrhoea* | U52069 | 174aa | 266aa | 22 | 153aa | 6.90E+00 |
| PG71 | Gliding motility protein (gldA), *Flavobacterium johnsoniae* | AF007381 | 578aa | 834aa | 23 | 572aa | 3.90E−25 |
| PG75 | Class 3 outer membrane porin (porB), *Neisseria meningitidis* | U07191 | 332aa | 391aa | 23 | 239aa | 4.60E−01 |
| PG81 | Outer membrane protein (ompA), *Shigella dysenteriae* | V01344 | 351aa | >235aa | 26 | 186aa | 3.10E−01 |
| PG82 | Outer membrane protein (alkL), *Pseudomonas oleovorans* | X65936 | 230aa | 434aa | 26 | 136aa | 2.80E+00 |
| PG83 | Gliding motility protein (gldA), *Flavobacterium johnsoniae* | AF007381 | 578aa | 926aa | 21 | 639aa | 8.50E−09 |
| PG87 | Hypothetical protein, *Mycobacterium tuberculosis* | AL021942 | 877aa | 781aa | 29 | 794aa | 2.20E−34 |
| PG89 | NADH-ubiquinone oxidoreductase, *Helicobacter pylori* | AE000631 | 512aa | 259aa | 24 | 186aa | 3.90E−01 |
| PG91 | Neuraminidase (nanH), *Bacteroides fragilis* | D28493 | 544aa | 540aa | 24 | 251aa | 1.60E+00 |
| PG92 | Hypothetical protein, *Mycobacterium tuberculosis* | AL021942 | 877aa | 771aa | 29 | 770aa | 8.00E−30 |
| PG93 | Cytoadherence protein P1, *Mycoplasma pneumoniae* | X07191 | 219aa | 776aa | 41 | 63aa | 6.90E−01 |
| PG94 | Arginyl endopeptidase, *Porphyromonas gingivalis* | D26470 | 991aa | 1157aa | 24 | 328aa | 7.60E−08 |
| PG95 | Sensor protein (EVGS), *Escherichia coli* | D14008 | 1197aa | 961aa | 28 | 511aa | 2.60E−17 |
| PG105 | Plasma cell membrane glycoprotein, Human | P22413 | 873aa | 449aa | 34 | 404aa | 5.60E−33 |
| PG106 | Hypothetical secreted protein, *Helicobacter pylori* | O24951 | 242aa | 246aa | 30 | 252aa | 7.80E−22 |
| PG107 | Cell division ATP binding protein, *Mycobacterium leprae* | O32883 | 229aa | 246aa, 241aa, 232aa | 46 | 193aa | 1.20E−26 |
| PG108 | ABC transporter, *Archaeoglobus fulgidus* | O29244 | 228aa | 219aa | 51 | 219aa | 3.80E−41 |
| PG109 | Proteinase IV, *Escherichia coli* | F64936 | 618aa | 595aa, 589aa | 38 | 597aa | 1.10E−57 |
| PG110 | Preprotein translocase, *Staphylococcus aureus* | O06446 | 843aa | 523aa | 43 | 521aa | 6.00E−71 |
| PG111 | ABC transporter, *Synechocystis* sp. | P73758 | 574aa | >720aa | 40 | 579aa | 1.70E−73 |
| PG112 | Glycosyl transferase, *Erwinia amylovora* | Q46634 | 351aa | 375aa, 362aa | 31 | 363aa | 1.60E−32 |
| PG113 | Heat shock protein (dnak), *Treponema pallidum* | AE001203 | 635aa | 640aa | 62 | 644aa | 9.10E−138 |
| PG114 | Dihydrolipamide dehydrogenase, *Clostridium magnum* | Q59299 | 578aa | 449aa | 37 | 450aa | 3.80E−54 |
| PG115 | Zinc protease, *Escherichia coli* | P31828 | 931aa | 941aa | 27 | 890aa | 6.60E−57 |
| PG116 | Heat shock protein (HTPG), *Escherichia coli* | P10413 | 624aa | 684aa | 32 | 627aa | 4.60E−48 |
| PG117 | Transcriptional regulator, *Aquifex aeolicus* | O66591 | 506aa | 464aa | 39 | 389aa | 2.40E−49 |
| PG118 | ABC transporter, *Bacillus subtilis* | H70019 | 261aa | 250aa | 59 | 251aa | 1.50E−60 |
| PG119 | ATP-dependent protease, *Aquifex aeolicus* | O66827 | 444aa | 461aa | 46 | 458aa | 1.60E−77 |
| PG120 | Nitrogen assimilation regulatory protein, *Bradyrhizobium* sp. | P10576 | 480aa | 457aa | 49 | 242aa | 3.80E−45 |
| PG121 | Cobalamin synthesis protein, *Bacillus megaterium* | E1331323 | 367aa | 602aa | 36 | 324aa | 9.20E−37 |
| PG122 | Outer membrane integrity (tolA), *Haemophilus influenzae* | P71397 | 819aa | 443aa | 37 | 441aa | 1.90E−54 |
| PG123 | Fimbrillin, *Porphyromonas gingivalis* | D1034032 | 490aa | 479aa | 32 | 480aa | 7.30E−48 |
| PG124 | Heat shock protein (dnaJ), *Leptospira interrogans* | AF007813 | 369aa | 383aa | 46 | 356aa | 2.30E−57 |
| PG125 | Cobalamin biosynthesis protein(CBIK), *Salmonella typhimurium* | Q05592 | 264aa | 293aa | 37 | 259aa | 3.70E−26 |
| PG126 | ABC-type permease, *Pseudomonas aeruginosa* | O68878 | 326aa | 356aa | 33 | 333aa | 1.30E−30 |
| PG127 | Endonuclease excision repair protein (uvrB), *Pseudomonas aeruginosa* | X93486 | 670aa | 678aa | 56 | 675aa | 1.10E−134 |

TABLE 3

Results of PSORT, SignalP and TopPred analysis of the proteins. The signal present column indicates the presence of a signal sequence detected with either PSORT or SignalP. The terms in parentheses indicates the type of signal sequence as determined by PSORT. The cell location & probability values are generated by PSORT and represent the probability of the protein being in the cell compartments outer membrane (OM), inner membrane (IM), periplasmic space (PC) or cytoplasm (C). The number of transmembrane domains (TMDs) was determined by TopPred and does not include uncleavable signal sequences.

| Protein name | Protein seqID number | Protein Length | Signal Present | Methionine in ORF | SignalP cleavage site | PSORT cleavage site | OM | IM | PS | C | C-terminal Amino Acid | Number of TMD's |
|---|---|---|---|---|---|---|---|---|---|---|---|---|
| PG1 | 386 | 451aa | Y | 1 | 24 | 34 | 0 | 0 | 0 | 0.22 | N | 0 |
| PG2 | 424 | 1017aa | Y | 1 | 20 | 20 | 0.94 | 0 | 0.33 | 0 | F | 3 |
| PG2 | 425 | 1014aa | Y | 2 | 17 | 17 | 0.94 | 0 | 0.29 | 0 | F | 3 |
| PG3 | 434 | 223aa | Y (lipoprotein) | 1 | — | 18 | 0.79 | 0.76 | 0 | 0 | K | 3 |
| PG4 | 447 | 672aa | Y (lipoprotein) | 1 | 22 | 22 | 0.79 | 0.7 | 0 | 0 | R | 0 |
| PG5 | 458 | 315aa | Y | 1 | 40 | 35 | 0 | 0.25 | 0 | 0 | R | 0 |
| PG6 | 475 | 324aa | N | 1 | — | — | 0 | 0 | 0 | 0.2 | S | 1 |
| PG7 | 487 | 404aa | N | 1 | 7 | — | 0 | 0.42 | 0 | 0 | E | 3 |
| PG8 | 498 | 598aa | N | 1 | — | — | 0 | 0 | 0 | 0.22 | N | 0 |
| PG8 | 499 | 550aa | N | 2 | — | — | 0 | 0 | 0 | 0.25 | N | 0 |
| PG8 | 500 | 458aa | N | 3 | — | — | 0 | 0 | 0 | 0.34 | N | 0 |
| PG8 | 501 | 426aa | N | 4 | — | — | 0 | 0 | 0 | 0.24 | N | 0 |
| PG9 | 515 | 1266aa | N | 1 | 7 | — | 0 | 0 | 0 | 0.22 | E | 1 |
| PG9 | 516 | 1232aa | N | 2 | — | — | 0 | 0 | 0 | 0.39 | E | 1 |
| PG9 | 517 | 1174aa | N | 3 | — | — | 0 | 0 | 0 | 0.47 | E | 1 |
| PG10 | 387 | 195aa | N | 1 | — | — | 0 | 0 | 0 | 0.11 | K | 0 |
| PG11 | 400 | 313aa | Y | 1 | 22 | 26 | 0.24 | 0 | 0.93 | 0 | R | 1 |
| PG12 | 411 | 271aa | Y (lipoprotein) | 3 | 27 | 29 | 0.79 | 0.7 | 0 | 0 | R | 0 |
| PG13 | 419 | 757aa | Y | 1 | 23 | 25 | 0.94 | 0 | 0.29 | 0 | N | 0 |
| PG14 | 420 | 331aa | Y (uncleavable) | 1 | 35 | 26 | 0 | 0.58 | 0 | 0 | K | 1 |
| PG15 | 421 | 267aa | Y | 2 | 24 | 18 | 0 | 0.11 | 0 | 0 | K | 1 |
| PG16 | 422 | 569aa | Y (lipoprotein) | 1 | 24 | 18 | 0.79 | 0.7 | 0 | 0 | G | 0 |
| PG18 | 423 | 981aa | Y | 1 | 30 | — | 0 | 0.56 | 0 | 0 | K | 11 |
| PG21 | 426 | 821aa | Y | 2 | 24 | 27 | 0.34 | 0 | 0.37 | 0 | G | 1 |
| PG22 | 427 | 106aa | Y (uncleavable) | 1 | 41 | 41 | 0 | 0.29 | 0 | 0 | P | 0 |
| PG23 | 428 | 859aa | N | 1 | — | — | 0 | 0.12 | 0 | 0 | A | 1 |
| PG24 | 429 | 417aa | Y | 1 | 19 | 19 | 0 | 0.44 | 0 | 0 | N | 3 |
| PG25 | 430 | 293aa | Y | 1 | 27 | 28 | 0.2 | 0 | 0.62 | 0 | R | 0 |
| PG27 | 431 | 312aa | N | 1 | — | — | 0 | 0 | 0 | 0.28 | Q | 1 |
| PG28 | 432 | 843aa | Y | 1 | 21 | 21 | 0.93 | 0 | 0.24 | 0 | H | 1 |
| PG29 | 433 | 290aa | Y | 1 | 18 | 16 | 0.28 | 0 | 0.94 | 0 | K | 1 |
| PG30 | 435 | 337aa | Y | 1 | 21 | 21 | 0.24 | 0 | 0.4 | 0 | K | 0 |
| PG31 | 436 | 151aa | N | 1 | — | — | 0 | 0 | 0 | 0.3 | T | 0 |
| PG32 | 437 | 391aa | Y | 1 | 20 | 20 | 0.62 | 0 | 0.13 | 0 | K | 0 |
| PG33 | 438 | 385aa | Y | 1 | 26 | 26 | 0.81 | 0 | 0.31 | 0 | E | 1 |
| PG34 | 439 | 190aa | Y | 1 | — | 13 | 0 | 0.5 | 0 | 0 | A | 5 |
| PG34 | 440 | 186aa | Y (uncleavable) | 2 | — | 47 | 0 | 0.5 | 0 | 0 | A | 4 |
| PG35 | 441 | 833aa | Y | 1 | 22 | 22 | 0.94 | 0 | 0.37 | 0 | F | 1 |
| PG36 | 442 | 891aa | Y (uncleavable) | 1 | — | 40 | 0 | 0.31 | 0 | 0 | F | 2 |
| PG37 | 443 | 174aa | Y (uncleavable) | 1 | 28 | 24 | 0 | 0.35 | 0 | 0 | K | 0 |
| PG37 | 444 | 170aa | Y (uncleavable) | 2 | 24 | 20 | 0 | 0.35 | 0 | 0 | K | 0 |
| PG38 | 445 | 163aa | Y | 1 | 18 | 18 | 0.21 | 0 | 0.93 | 0 | K | 1 |
| PG39 | 446 | 827aa | Y | 1 | 36 | 36 | 0.93 | 0 | 0.25 | 0 | F | 3 |
| PG40 | 448 | 772aa | Y | 2 | 19 | 19 | 0.94 | 0 | 0.32 | 0 | F | 4 |
| PG41 | 449 | 462aa | Y | 2 | 27 | 27 | 0.25 | 0 | 0.54 | 0 | Q | 2 |
| PG42 | 450 | 492aa | Y | 5 | 30 | — | 0 | 0 | 0.00 | 0.13 | Q | 2 |
| PG43 | 451 | 245aa | Y (uncleavable) | 2 | 28 | 22 | 0 | 0.38 | 0 | 0 | K | 1 |
| PG44 | 452 | 276aa | Y | 1 | 19 | 24 | 0.15 | 0 | 0.89 | 0 | K | 0 |
| PG45 | 453 | 775aa | Y (lipoprotein) | 1 | 19 | 23 | 0.79 | 0.7 | 0 | 0 | F | 4 |
| PG46 | 454 | 774aa | Y | 1 | 27 | 27 | 0.73 | 0 | 0.22 | 0 | F | 2 |
| PG47 | 455 | 867aa | Y | 1 | 24 | 24 | 0.94 | 0 | 0.38 | 0 | F | 2 |
| PG48 | 456 | 431aa | Y | 1 | 24 | 24 | 0 | 0.1 | 0 | 0 | R | 1 |
| PG49 | 457 | 333aa | Y (uncleavable) | 1 | 24 | 18 | 0 | 0.12 | 0 | 0 | I | 0 |
| PG50 | 459 | 848aa | Y | 1 | 21 | 21 | 0.94 | 0 | 0.34 | 0 | F | 3 |
| PG51 | 460 | 202aa | Y | 1 | 26 | 25 | 0.2 | 0 | 0.61 | 0 | S | 0 |
| PG52 | 461 | 455aa | Y (uncleavable) | 1 | 23 | 21 | 0 | 0.18 | 0 | 0 | F | 1 |
| PG53 | 462 | 444aa | Y | 1 | 14 | 17 | 0.36 | 0 | 0.22 | 0 | D | 2 |
| PG54 | 463 | 940aa | Y | 1 | 27 | 20 | 0.86 | 0 | 0.25 | 0 | Q | 5 |
| PG55 | 464 | 670aa | Y (lipoprotein) | 1 | 23 | 23 | 0.79 | 0.7 | 0 | 0 | K | 2 |
| PG56 | 465 | 1282aa | Y (uncleavable) | 1 | — | 21 | 0 | 0.04 | 0 | 0 | K | 4 |
| PG56 | 466 | 1274aa | N | 2 | — | — | 0 | 0 | 0 | 0.27 | K | 5 |
| PG57 | 467 | 925aa | Y | 1 | 28 | 24 | 0.53 | 0 | 0.2 | 0 | P | 3 |
| PG57 | 468 | 922aa | Y | 2 | 25 | 21 | 0.53 | 0 | 0.2 | 0 | P | 3 |
| PG57 | 469 | 921aa | Y | 3 | 24 | 20 | 0.53 | 0 | 0.2 | 0 | P | 3 |
| PG58 | 470 | 593aa | Y | 1 | 24 | 24 | 0.82 | 0 | 0.19 | 0 | F | 1 |
| PG58 | 471 | 589aa | Y | 2 | 20 | 20 | 0.82 | 0 | 0.19 | 0 | F | 1 |

TABLE 3-continued

Results of PSORT, SignalP and TopPred analysis of the proteins. The signal present column indicates the presence of a signal sequence detected with either PSORT or SignalP. The terms in parentheses indicates the type of signal sequence as determined by PSORT. The cell location & probability values are generated by PSORT and represent the probability of the protein being in the cell compartments outer membrane (OM), inner membrane (IM), periplasmic space (PC) or cytoplasm (C). The number of transmembrane domains (TMDs) was determined by TopPred and does not include uncleavable signal sequences.

| Protein name | Protein seqID number | Protein Length | Signal Present | Methionine in ORF | SignalP cleavage site | PSORT cleavage site | Cell Location & probability | | | | C-terminal Amino Acid | Number of TMD's |
|---|---|---|---|---|---|---|---|---|---|---|---|---|
| | | | | | | | OM | IM | PS | C | | |
| PG59 | 472 | 346aa | Y | 1 | 37 | — | 0 | 0.18 | 0 | 0 | F | 1 |
| PG59 | 473 | 345aa | Y | 2 | 36 | 56 | 0.92 | 0 | 0.15 | 0 | F | 1 |
| PG59 | 474 | 330aa | Y | 3 | 21 | 41 | 0.93 | 0 | 0.25 | 0 | F | 1 |
| PG60 | 476 | 547aa | Y | 1 | 28 | 28 | 0.93 | 0 | 0.25 | 0 | F | 0 |
| PG61 | 477 | 749aa | Y | 2 | 21 | 21 | 0.94 | 0 | 0.29 | 0 | F | 3 |
| PG62 | 478 | 494aa | Y | 1 | 21 | 21 | 0.93 | 0 | 0.24 | 0 | F | 2 |
| PG63 | 479 | 294aa | Y | 1 | 20 | 20 | 0.93 | 0 | 0.24 | 0 | F | 1 |
| PG64 | 480 | 204aa | Y | 1 | 20 | 20 | 0.93 | 0 | 0.19 | 0 | F | 1 |
| PG65 | 481 | 243aa | Y | 1 | 18 | 18 | 0.93 | 0 | 0.25 | 0 | F | 1 |
| PG66 | 482 | 206aa | Y | 1 | 21 | 21 | 0.94 | 0 | 0.3 | 0 | F | 1 |
| PG67 | 483 | 950aa | Y | 1 | 28 | 36 | 0.93 | 0 | 0.27 | 0 | Y | 4 |
| PG68 | 484 | 1226aa | Y | 1 | 25 | 25 | 0.91 | 0 | 0.31 | 0 | Y | 0 |
| PG68 | 485 | 1225aa | Y | 2 | 24 | 24 | 0.91 | 0 | 0.31 | 0 | Y | 0 |
| PG69 | 486 | 425aa | Y | 1 | 29 | 29 | 0.93 | 0 | 0.21 | 0 | F | 1 |
| PG70 | 488 | 260aa | Y | 1 | 18 | 24 | 0.93 | 0 | 0.24 | 0 | F | 0 |
| PG71 | 489 | 834aa | Y | 2 | 20 | 20 | 0.94 | 0 | 0.31 | 0 | N | 2 |
| PG72 | 490 | 399aa | Y | 1 | 27 | 27 | 0.94 | 0 | 0.32 | 0 | H | 2 |
| PG73 | 491 | 382aa | Y | 2 | 20 | 20 | 0.94 | 0 | 0.3 | 0 | L | 1 |
| PG74 | 492 | 222aa | Y | 1 | 24 | 24 | 0.94 | 0 | 0.32 | 0 | L | 0 |
| PG75 | 493 | 391aa | Y | 1 | 26 | 26 | 0.94 | 0 | 0.3 | 0 | H | 1 |
| PG76 | 494 | 446aa | Y | 1 | 21 | 22 | 0.94 | 0 | 0.32 | 0 | V | 3 |
| PG77 | 495 | 308aa | Y | 2 | 28 | 28 | 0.94 | 0 | 0.38 | 0 | K | 0 |
| PG78 | 496 | 314aa | Y | 1 | 23 | 23 | 0.94 | 0 | 0.29 | 0 | D | 0 |
| PG79 | 497 | 285aa | Y | 1 | — | 32 | 0.93 | 0 | 0.26 | 0 | G | 2 |
| PG80 | 502 | 240aa | Y | 1 | 19 | 19 | 0.93 | 0 | 0.22 | 0 | N | 2 |
| PG81 | 366 | >235aa | Y | 1 | 28 | 20 | 0.93 | 0 | 0.21 | 0 | Q | 1 |
| PG82 | 503 | 434aa | Y | 1 | 30 | 24 | 0.93 | 0 | 0.2 | 0 | N | 3 |
| PG83 | 504 | 926aa | Y | 1 | 23 | 57 | 0.93 | 0 | 0.21 | 0 | S | 1 |
| PG84 | 505 | 400aa | Y | 1 | 25 | 25 | 0.93 | 0 | 0.25 | 0 | N | 1 |
| PG84 | 506 | 398aa | Y | 2 | 23 | 23 | 0.93 | 0 | 0.25 | 0 | N | 1 |
| PG85 | 507 | 581aa | Y | 1 | 20 | 20 | 0.93 | 0 | 0.46 | 0 | L | 2 |
| PG86 | 508 | 239aa | Y | 1 | 44 | — | 0 | 0 | 0 | 0.12 | H | 0 |
| PG86 | 509 | 211aa | Y | 2 | 16 | 46 | 0.91 | 0 | 0.03 | 0 | H | 0 |
| PG87 | 510 | 781aa | Y | 1 | 26 | 47 | 0.89 | 0 | 0.21 | 0 | N | 2 |
| PG88 | 511 | 271aa | Y | 2 | 28 | 19 | 0.89 | 0 | 0.25 | 0 | P | 0 |
| PG88 | 512 | 270aa | Y | 3 | 27 | 18 | 0.89 | 0 | 0.25 | 0 | P | 0 |
| PG88 | 513 | 267aa | Y | 4 | 24 | 15 | 0.89 | 0 | 0.23 | 0 | P | 0 |
| PG89 | 514 | 259aa | Y | 2 | 23 | 25 | 0.88 | 0 | 0.35 | 0 | N | 1 |
| PG90 | 518 | 229aa | Y | 1 | 22 | 21 | 0.85 | 0 | 0.44 | 0 | K | 0 |
| PG90 | 519 | 228aa | Y | 2 | 21 | 20 | 0.85 | 0 | 0.44 | 0 | K | 0 |
| PG91 | 520 | 540aa | Y | 1 | 25 | 25 | 0.85 | 0 | 0.30 | 0 | E | 0 |
| PG92 | 521 | 771aa | Y | 2 | 19 | 19 | 0.85 | 0 | 0.3 | 0 | R | 3 |
| PG93 | 522 | 776aa | Y | 1 | 25 | 25 | 0.85 | 0 | 0.37 | 0 | R | 4 |
| PG94 | 523 | 1157aa | Y | 1 | 23 | 28 | 0.8 | 0 | 0.25 | 0 | Q | 5 |
| PG95 | 524 | 961aa | Y (lipoprotein) | 1 | — | 19 | 0.79 | 0.87 | 0 | 0 | V | 1 |
| PG96 | 525 | 563aa | Y | 1 | 23 | 23 | 0.40 | 0 | 0.33 | 0 | K | 0 |
| PG97 | 526 | 437aa | Y | 1 | 23 | 23 | 0.32 | 0 | 0.65 | 0 | Q | 0 |
| PG98 | 527 | 318aa | Y (lipoprotein) | 1 | 19 | 19 | 0.79 | 0.7 | 0 | 0 | L | 1 |
| PG99 | 528 | 461aa | Y (uncleavable) | 1 | 22 | 20 | 0 | 0 | 0.3 | 0 | R | 0 |
| PG100 | 388 | 279aa | Y | 1 | 20 | 18 | 0.26 | 0 | 0.54 | 0 | I | 0 |
| PG101 | 268 | >157aa | N (ORF incomplete) | | — | — | | | | | R | 1 |
| PG102 | 389 | 562aa | Y | 1 | 29 | 29 | 0.19 | 0 | 0.4 | 0 | S | 3 |
| PG102 | 390 | 558aa | Y | 2 | 25 | 25 | 0.26 | 0 | 0.46 | 0 | S | 3 |
| PG104 | 391 | 391aa | Y | 1 | 17 | 17 | 0.62 | 0 | 0.22 | | R | 0 |
| PG105 | 392 | 449aa | Y | 1 | 22 | 19 | 0.31 | 0 | 0.91 | 0 | P | 3 |
| PG106 | 393 | 246aa | Y | 2 | 41 | 49 | 0 | 0 | 0 | 0.02 | L | 0 |
| PG107 | 394 | 246aa | N | 1 | — | — | 0 | 0 | 0 | 0.32 | D | 1 |
| PG107 | 395 | 241aa | N | 2 | — | — | 0 | 0 | 0 | 0.3 | D | 1 |
| PG107 | 396 | 232aa | N | 3 | — | — | 0 | 0 | 0 | 0.21 | D | 1 |
| PG108 | 397 | 219aa | N | 1 | — | — | 0 | 0 | 0 | 0.19 | R | 1 |
| PG109 | 398 | 595aa | Y | 1 | 35 | 37 | 0.26 | 0 | 0.93 | 0 | Y | 3 |
| PG109 | 399 | 589aa | Y | 2 | 29 | 31 | 0.27 | 0 | 0.93 | 0 | Y | 3 |
| PG110 | 401 | >523aa | N | 1 | — | — | 0 | 0 | 0 | 0.38 | in-complete | 0 |

TABLE 3-continued

Results of PSORT, SignalP and TopPred analysis of the proteins. The signal present column indicates the presence of a signal sequence detected with either PSORT or SignalP. The terms in parentheses indicates the type of signal sequence as determined by PSORT. The cell location & probability values are generated by PSORT and represent the probability of the protein being in the cell compartments outer membrane (OM), inner membrane (IM), periplasmic space (PC) or cytoplasm (C). The number of transmembrane domains (TMDs) was determined by TopPred and does not include uncleavable signal sequences.

| Protein name | Protein seqID number | Protein Length | Signal Present | Methionine in ORF | SignalP cleavage site | PSORT cleavage site | OM | IM | PS | C | C-terminal Amino Acid | Number of TMD's |
|---|---|---|---|---|---|---|---|---|---|---|---|---|
| PG111 | 278 | >720aa | N (ORF incomplete) | — | — | — | | | | | G | 1 |
| PG112 | 402 | 375aa | Y | 1 | — | 43 | 0 | 0.12 | 0 | 0 | N | 1 |
| PG112 | 403 | 362aa | Y | 2 | — | 30 | 0 | 0 | 0.12 | 0 | N | 1 |
| PG113 | 404 | 640aa | N | 1 | — | — | 0 | 0 | 0 | 0.25 | K | 1 |
| PG114 | 405 | 449aa | N | 1 | — | — | 0 | 0.12 | 0 | 0 | G | 4 |
| PG115 | 406 | 941aa | Y | 1 | 23 | 22 | 0.13 | 0 | 0.92 | 0 | Q | 2 |
| PG116 | 407 | 684aa | N | 1 | — | — | 0 | 0.12 | 0 | 0 | L | 2 |
| PG117 | 408 | 464aa | N | 1 | — | — | 0 | 0.19 | 0 | 0 | L | 1 |
| PG118 | 409 | 250aa | N | 1 | — | — | 0 | 0 | 0 | 0.27 | E | 1 |
| PG119 | 410 | 461aa | N | 1 | — | — | 0 | 0.28 | 0 | 0 | E | 2 |
| PG120 | 412 | 457aa | N | 1 | — | — | 0 | 0 | 0 | 0.21 | E | 0 |
| PG121 | 413 | 602aa | N | 1 | — | — | 0 | 0 | 0 | 0.31 | E | 3 |
| PG122 | 414 | 443aa | N | 1 | — | — | 0 | 0 | 0 | 0.14 | Q | 4 |
| PG123 | 415 | 479aa | Y | 2 | 22 | 22 | 0.26 | 0 | 0.94 | 0 | K | 0 |
| PG124 | 416 | 383aa | N | 1 | — | — | 0 | 0 | 0 | 0.29 | D | 2 |
| PG125 | 417 | 293aa | Y | 1 | 23 | 15 | 0.18 | 0 | 0.93 | 0 | R | 1 |
| PG126 | 418 | 356aa | N | 1 | — | — | 0 | 0.52 | 0 | 0 | D | 9 |
| PG127 | 532 | 678aa | N | 1 | — | — | 0 | 0 | 0 | 0.28 | A | 2 |

TABLE 4

Percentage identity and percentage similarity of various proteins with the 70 amino acids from the C-terminal of the P. gingivalis arginine protease 1 (RGP1), arginine protease 2 (RGP2), and the cysteine protease/hemagglutinin (prtT).

| Protein name | Percent identity | | | Percent similarity | | |
|---|---|---|---|---|---|---|
| | RGP1 | RGP2 | prtT | RGP1 | RGP2 | prtT |
| PG21 | 17 | 29 | 21 | 40 | 57 | 49 |
| PG25 | 43 | 41 | 9 | 64 | 73 | 14 |
| PG27 | 41 | 33 | 7 | 73 | 74 | 11 |
| PG28 | 21 | 26 | 34 | 49 | 57 | 74 |
| PG54 | 19 | 13 | 16 | 40 | 43 | 33 |
| PG57 | 11 | 14 | 19 | 20 | 24 | 34 |
| PG91 | 31 | 21 | 39 | 57 | 53 | 74 |
| PG96 | 0 | 13 | 20 | 0 | 24 | 43 |
| PG97 | 10 | 26 | 33 | 14 | 47 | 61 |
| PG98 | 16 | 20 | 0 | 47 | 54 | 0 |
| PG99 | 19 | 0 | 26 | 41 | 0 | 54 |
| PG100 | 20 | 21 | 24 | 39 | 57 | 41 |
| PG101 | 11 | 16 | 27 | 17 | 39 | 60 |
| PG102 | 27 | 20 | 31 | 50 | 61 | 61 |
| PG104 | 16 | 23 | 26 | 46 | 44 | 49 |

TABLE 5

Percentage identity and percentage similarity of various proteins with the TonBIII box of P. gingivalis.

| Protein name | Percent identity | Percent similarity |
|---|---|---|
| PG2 | 46 | 71 |
| PG13 | 57 | 93 |
| PG35 | 50 | 96 |
| PG47 | 39 | 71 |
| PG50 | 54 | 93 |

Cloning, Expression and Purification of Recombinant P. gingivalis Genes.

PG1

Oligonucleotides to the 5' and 3' regions of the deduced protein were used to amplify the gene of interest from a preparation of P. gingivalis W50 genomic DNA using the TaqPlus Precision PCR System (Stratagene) and a PTC-100 (MJ Research) thermal cycler or similar device. The 5' oligonucleotide primer sequence was GCGCCATATGCTGGC-CGAACCGGCC, (SEQ ID NO: 533) the 3' oligonucleotide primer sequence was GCGCCTCGAGTCAATTCATTTC-CTTATAGAG (SEQ ID NO: 534). The PCR fragment was purified, digested with Nde I, Xho I restriction enzymes (Promega) and ligated into the corresponding sites of the plasmid pProEx-1 (Gibco-BRL) and transformed into E. coli ER1793 cells (a gift from Elizabeth Raleigh, New England Biolabs). A resulting clone expressing the correct insert was selected and induced with or without 0.1 mM IPTG (Promega) for expression of the recombinant protein. Expression of the recombinant protein was determined by SDS-PAGE analysis and Western Blot using the one of the rabbit antisera described above or an anti-hexahistidine antibody (Clontech) that detects the hexahistidine tag that was fused to the P. gingivalis recombinant protein. PG1 was purified by disruption of the E. coli cells by sonication in binding buffer (Novagen) and solubilisation by the addition of sarkosyl (N-Lauroyl sarcosine) to a 1% final concentration. There after the preparation was diluted to 0.1% sarkosyl in binding buffer, bound to a Nickel-nitrilotriacetic acid column (Ni-NTA; Qiagen), after washing bound proteins were eluted with 1M imidazole in elution buffer (Novagen) according to the Qiagen recommendations with 0.1% sarkosyl added to all buffers. Following purification samples were dialysed against 500 mM NaCl, 20 mM Tris, 0.1% sarkosyl at pH7.4 to remove the imidazole, concentrated as required and stored at 40 C until used. Purity and antigenicity were assessed by SDS-PAGE and Western blot using selected antisera (from those described above) and the protein concentration was determined by the BCA assay (Pierce).

PG2

The methods used for PG2 were essentially the same as for PG1 with the following exceptions. The 5' oligonucleotide primer sequence was CGCGGTATACATGAAAAGAAT-GACGC, (SEQ ID NO: 535) the 3' oligonucleotide primer sequence was CGCGAGATCTGAAAGACAACT-GAATACC (SEQ ID NO: 536) and the PCR product was cloned into pGex-stop RBS(IV) (Patent application WO9619496, J C Cox, S E Edwards, I Frazer and E A Webb. Variants of human papilloma virus antigens) using the BstZ 171 and Bgl II restriction sites. 2% sarkosyl was used to solubilise PG2 and 8M urea was added to the solublisation buffer and to all other buffers. Urea was removed from the purified protein by sequential dialysis (4M then 2M then 1M then 0.5M then 0M urea all in 50 mM Tris, 500 mM NaCl, 0.1% sarkosyl, pH7.4). Purified protein was stored at 4° C. until required.

PG3

The methods used for PG3 were essentially the same as for PG1 with the following exceptions. The 5' oligonucleotide primer sequence was GCGCGTATACATGAAGAAAT-CAAGTGTAG, (SEQ ID NO: 537) the 3' oligonucleotide primer sequence was GCGCAGATCTCTTCAGCGTACCT-TGCTGTG (SEQ ID NO: 538) and DNA was amplified with Pfu DNA polymerase (Stratagene). The PCR product was cloned directly into pCR-Blunt and transformed into E. coli Top10F' (InVitrogen) before subcloning into the expression plasmid pGex-stop RBS(IV) using the Bst Z171 and Bgl II restriction sites and transformed into E. coli BL21DE3 (Pharmacia Biotech). The following modifications were made to the purification of PG3 from the PG1 method. Cells expressing the recombinant protein were disrupted by sonication in binding buffer and the insoluble inclusion bodies concentrated by centrifugation. Inclusion bodies were then solubilised in 6M urea (Sigma) in binding buffer and eluted with 6M urea added to the elution buffer. In some instances 6M guanidine hydrochloride (Sigma) was used instead of urea for these steps. Urea (or guanidine hydrochloride when it was substituted) was removed from the purified protein by sequential dialysis against reducing levels of urea (3M then 1.5M then 0.5M then 0M urea all in 50 mM Tris, 500 mM NaCl, 8% glycerol, pH7.4). Purified protein was stored frozen at –800C until required. Protein concentration was determined by the Coomassie Plus protein assay (Pierce).

PG4

The methods used for PG4 were essentially the same as for PG3 with the following exceptions. The 5' oligonucleotide primer sequence was CTTCTGTATACTTACAGCGGA-CATCATAAAATC, (SEQ ID NO: 539) the 3' oligonucleotide primer sequence was TTCCAGGAGGGTACCACG-CAACTCTTCTTCGAT (SEQ ID NO: 540) and DNA was amplified with the Tth XL PCR kit (Perkin Elmer). The PCR product was cloned into the expression plasmid pGex-stop RBS(IV) using the Bst Z171 and Kpn I restriction sites and transformed into E. coli ER1793.

PG5

The methods used for PG5 were essentially the same as for PG3 with the following exceptions. The 5' oligonucleotide primer sequence was TTGCAACATATGATCAGAAC-GATACTTTCA, (SEQ ID NO: 541) the 3' oligonucleotide primer sequence was AGCAATCTCGAGCGGTTCAT-GAGCCAAAGC (SEQ ID NO: 542) and DNA was amplified with the Tth XL PCR kit. The PCR product was cloned into the expression plasmid pET24 (Novagen) using the Nde I and Xho I restriction sites and transformed into E. coli BL21 (Pharmacia Biotech). Removal of urea was not proceeded past 1M urea as the protein was insoluble at lower concentrations of urea. Purified protein was stored at 40 C until required.

PG6

The methods used for PG6 were essentially the same as for PG3 with the following exceptions. The 5' oligonucleotide primer sequence was TAAACATATGTGCCTCGAAC-CCATAATTGCTCCG, (SEQ ID NO: 543) the 3' oligonucleotide primer sequence was CGTCCGCG-GAAGCTTTGATCGGCCATTGCTACT (SEQ ID NO: 544) and DNA was amplified with the Tth XL PCR kit. The PCR product was cloned into the expression plasmid pET24a using the Nde I and Hind III restriction sites and transformed into E. coli BL21.

PG8

The methods used for PG8 were essentially the same as for PG3 with the following exceptions. The 5' oligonucleotide primer sequence was CGCGGTATACATGGAGTTCAA-GATTGT, (SEQ ID NO: 545) the 3' oligonucleotide primer sequence was CGCGAGATCTGTTTTCTGAAAGCTTTTC (SEQ ID NO: 546) and DNA was amplified with the TaqPlus Precision PCR System. The PCR product was cloned into the expression plasmid pProEx-1 using the Nde I and Xho I restriction sites and transformed into E. coli ER1793.

PG8A

PG8A is a shortened version of PG8 and has the first 173 amino acids removed. The methods used for PG8A were essentially the same as for PG3 with the following exceptions. The 5' oligonucleotide primer sequence was CGCGGTATA-CATGGAAAACTTAAAGAAC, (SEQ ID NO:547) the 3' oligonucleotide primer sequence was CGCGAGATCT-GTTTTCTGAAAGCTTTTC (SEQ ID NO: 548) and DNA was amplified with the TaqPlus Precision PCR System. The PCR product was cloned into the expression plasmid pGex-stop RBS(IV) using the Bst Z171 and Bgl II restriction sites and transformed into E. coli ER1793. Prior to dialysis of the purified protein EDTA (Sigma) was added to a final concentration of 10 mM.

PG10

The methods used for PG10 were essentially the same as for PG3 with the following exceptions. The 5' oligonucleotide primer sequence was CGCGGATATCATGGATAAAGT-GAGCTATGC, (SEQ ID NO: 549) the 3' oligonucleotide primer sequence was CGCGAGATCTTTTGTTGATACT-CAATAATTC (SEQ ID NO:550) and DNA was amplified with the TaqPlus Precision PCR System. The PCR product was digested with Eco RV and Bgl II and ligated into the expression plasmid pGex-stop RBS(IV) using the Bst Z17I and Bgl II restriction sites and transformed into *E. coli* ER1793.

PG11

The methods used for PG11 were essentially the same as for PG1 with the following exceptions. The 5' oligonucleotide primer sequence was GCGCGTATACATGAGAGCAAA-CATTTGGCAGATACTTTCCG, (SEQ ID NO: 551) the 3' oligonucleotide primer sequence was GCGCAGATCTGCG-CAAGCGCAGTATATCGCC (SEQ ID NO: 552) and DNA was amplified with Tli DNA polymerase (Promega). The PCR product was cloned into pCR-Blunt and transformed into *E. coli* Top10F' before subcloning into the expression plasmid pGex-stop RBS(IV) using the Bst Z17I and Bgl II restriction sites and transformed into *E. coli* ER1793. PG11 was purified by solubilisation of *E. coli* cells with 2% sarkosyl in binding buffer (Qiagen) which was diluted to 0.1% sarkosyl in binding buffer, bound to a Nickel-nitrilotriacetic acid column (Ni-NTA; Qiagen), after washing bound proteins were eluted with 1M imidazole (0.7% CHAPS (Sigma) in elution buffer; Qiagen) according to the Qiagen recommendations. Following purification samples were dialysed against 500 mM NaCl, 20 mM Tris, 0.7% CHAPS, 20% glycerol (Sigma) at pH7.4 to remove the imidazole, concentrated as required and stored at 4° C. until used.

PG12

The methods used for PG12 were essentially the same as for PG1 with the following exceptions. The 5' oligonucleotide primer sequence was GCGCGTATACATGAATAGCAGA-CATCTGACAATCACAATCATTGCCGG, (SEQ ID NO: 553) the 3' oligonucleotide primer sequence was GCGCA-GATCTGCTGTTCTGTGAGTGCAGTTGTTTAAGTG (SEQ ID NO: 554) and DNA was amplified with Tli DNA polymerase. The PCR product was cloned into pCR-Blunt and transformed into *E. coli* Top10F' cells before subcloning into the expression plasmid pGex-stop RBS(IV) using the Bst Z17I and Bgl II restriction sites and transformed into *E. coli* BL21. Purification of the recombinant protein was essentially the same as PG11 except 0.5% DHPC (1,2-Diheptanoyl-sn-glycero-3-phosphocholine; Avanti) in 50 mM Tris, 50 mM NaCl, pH8.0 was used to solubilise the inclusion bodies instead of sarkosyl and the DHPC was diluted to 0.1% before addition to the Ni-NTA and 0.1% DHPC was added to all buffers.

PG13

The methods used for PG13 were essentially the same as for PG3 with the following exceptions. The 5' oligonucleotide primer sequence was GCGCCATATGCGGACAAAAAC-TATCTTTTTTGCG, (SEQ ID NO: 555) the 3' oligonucleotide primer sequence was GCGCCTCGAGGTTGT-TGAATCGAATCGCTATTTGAGC (SEQ ID NO: 556) and DNA was amplified with Tli DNA polymerase. The PCR product was cloned the expression plasmid pET24b using the Nde I and Xho I restriction sites and transformed into *E. coli* BL21. Purification of the recombinant protein was essentially the same as PG3 using 6M urea and 1% NOG (n-octyl glucoside; Sigma) was added to the dialysis buffer. Removal of urea was not proceeded past 2M urea as the protein was insoluble at lower concentrations of urea. Purified protein was stored at 4° C. until required.

PG14

The methods used for PG12 were essentially the same as for PG1 with the following exceptions. The 5' oligonucleotide primer sequence was GCGCGGCGCCATGACGGACAA-CAAACAACGTAATATCG, (SEQ ID NO: 557) the 3' oligo-nucleotide primer sequence was GCGCCTCGAGTTACT-TGCGTATGATCACGGACATACCC (SEQ ID NO: 558) and DNA was amplified with Tli DNA polymerase. The PCR product was cloned the expression plasmid pProEx-1 using the Ehe I and Xho I restriction sites and transformed into *E. coli* BL21. Purification of the recombinant protein was essentially the same as PG12.

PG15

The methods used for PG15 were essentially the same as for PG3 with the following exceptions. The 5' oligonucleotide primer sequence was CAAAAGTATACTAATAAATATCAT-TCTCAA, (SEQ ID NO: 559) the 3' oligonucleotide primer sequence was GCTTATGGTACCTTTGGTCTTATCTAT-TAT (SEQ ID NO: 560) and DNA was amplified with the Tth XL PCR kit. The PCR product was cloned into the expression plasmid pGex-stop RBS(IV) using the Bst Z17I and Kpn I restriction sites and transformed into *E. coli* ER1793.

PG22

The methods used for PG22 were essentially the same as for PG1 with the following exceptions. The 5' oligonucleotide primer sequence was CCCCGGATCCGATGCGACTGAT-CAAGGC, (SEQ ID NO: 561) the 3' oligonucleotide primer sequence was CCCCCTCGAGCGGAACGGGGTCAT-AGCC and DNA (SEQ ID NO: 562) was amplified with the TaqPlus Precision PCR System. The PCR product was cloned into the expression plasmid pET24b using the Bam HI and Xho I restriction sites and transformed into *E. coli* BL21DE3. Once PG22 was purified dialysis was performed in the same manner as for PG1 but in the presence of 1M imidazole.

PG24

The methods used for PG24 were essentially the same as for PG3 with the following exceptions. The 5' oligonucleotide primer sequence was CGCGGTATACATGAATTACCTG-TACATAC, (SEQ ID NO: 563) the 3' oligonucleotide primer sequence was CGCGGGATCCGTTCGATTGGTCGTC-GATGG (SEQ ID NO: 564) and DNA was amplified with the TaqPlus Precision PCR System. The PCR product was digested with Bst Z17I and Bam HI and ligated into the expression plasmid pGex-stop RBS(IV) using the Bst Z17I and Bgl II restriction sites and transformed into *E. coli* ER1793. Due to the low level of expression of PG24 purification was not proceeded with except on small scale.

PG24A

A modified version of PG24 was also cloned and expressed. PG24A is the same as PG24 with the predicted N-terminal sequence removed. The methods used for PG24A were essentially the same as for PG3 with the following exceptions. The 5' oligonucleotide primer sequence was CGCGCATATGGAGATTGCTTTCCTTTCTTCG, (SEQ ID NO: 565) the 3' oligonucleotide primer sequence was CGCGCTCGAGTTAGTTCGATTGGTCGTCG (SEQ ID NO: 566) and DNA was amplified with the TaqPlus Precision PCR System. The PCR product was cloned into the expression plasmid pProEx-1 using the Nde I and Xho I restriction sites and transformed into *E. coli* ER1793. Purification of the recombinant protein was essentially the same as PG3 except 8M urea was used to solubilise the inclusion bodies and in the buffers used for the Ni-NTA column purification. Urea was removed by sequential dialysis (4M then 2M, then 1M then 0.5M then 0M urea all in 50 mM Tris, 500 mM NaCl, 8% glycerol, pH7.4). Purified protein was stored frozen at −80° C. until required.

PG29

The methods used for PG29 were essentially the same as for PG3 with the following exceptions. The 5' oligonucleotide primer sequence was GCGCGATATCGCTAGCAT-GAAAAAGCTATTTCTC, (SEQ ID NO: 567) the 3' oligonucleotide primer sequence was GCGCAGATCTCTC-GAGTTTGCCATCGGATTGCGGATTG (SEQ ID NO: 568) and DNA was amplified with Pfu DNA polymerase being used. The PCR product was cloned into pCR-Blunt (InVitrogen) and transformed into E. coli Top10F' before subcloning into the expression plasmid pGex-stop RBS(IV) using the EcoR V and Bgl II restriction sites and transformed into E. coli BL21. 6M urea was used throughout the purification process.

PG30

The methods used for PG30 were essentially the same as for PG3 with the following exceptions. The predicted N-terminal signal sequence was removed from the recombinant protein. The 5' oligonucleotide primer sequence was TACG-GAATTCGTGACCCCCGTCAGAAATGTGCGC, (SEQ ID NO: 569) the 3' oligonucleotide primer sequence was CTATGCGGCCGCTTTGATCCTCAAGGCTTTGCCCGG (SEQ ID NO: 570) and DNA was amplified with the Tth XL PCR kit. The PCR product was cloned into the expression plasmid pET24a using the Eco RI and Not I restriction sites and transformed into E. coli BL21DE3. Expression studies and immunoreactivity studies were carried out on whole E. coli lysates of PG30. 10 ml cultures of recombinant E. coli were grown to an OD of 2.0 ($A_{600\ nm}$) in terrific broth and the cells were induced with 0.5 mM IPTG and samples taken for analysis at 4 hours post induction. Purification was not done for these studies.

PG31

The methods used for PG31 were essentially the same as for PG30 with the following exceptions. The 5' oligonucleotide primer sequence was CGGGGAATTCGCAAAAAT-CAATTTCTATGCTGAA, (SEQ ID NO: 571) the 3' oligonucleotide primer sequence was CTATGCGGCCGCTGTATGCAATAGG-GAAAGCTCCGA (SEQ ID NO: 572) and DNA was amplified with the Tth XL PCR kit. The PCR product was cloned into the expression plasmid pET24a using the Eco RI and Not I restriction sites and transformed into E.coli BL21DE3. Expression studies and immunoreactivity studies were carried out on whole E. coli lysates. Purification was not done for these studies.

PG32

The methods used for PG32 were essentially the same as for PG30 with the following exceptions. The predicted N-terminal signal sequence was removed from the recombinant protein. The 5' oligonucleotide primer sequence was CGCA-GAATTCCAGGAGAATACTGTACCGGCAACG, (SEQ ID NO: 573) the 3' oligonucleotide primer sequence was CTAT-GCGGCCGCCTTGGAGCGAACGATTACAACAC (SEQ ID NO: 574) and DNA was amplified with the Tth XL PCR kit. The PCR product was cloned into the expression plasmid pET24a using the Eco RI and Not I restriction sites and transformed into E. coli BL21DE3. Expression studies and immunoreactivity studies were carried out on whole E. coli lysates. Purification was not done for these studies.

PG33

The methods used for PG33 were essentially the same as for PG30 with the following exceptions. The predicted N-terminal signal sequence was removed from the recombinant protein. The 5' oligonucleotide primer sequence was TGCA-GAATTCCAAGAAGCTACTACACAGAACAAA, (SEQ ID NO: 575) the 3' oligonucleotide primer sequence was CTATGCGGCCGCTTCCGCTGCAGTCATTACTACAA (SEQ ID NO: 576) and DNA was amplified with the Tth XL PCR kit. The PCR product was cloned into the expression plasmid pET24a using the Eco RI and Not I restriction sites and transformed into E. coli BL21DE3. Expression studies and immunoreactivity studies were carried out on whole E. coli lysates. Purification was not done for these studies.

PG35

The methods used for PG35 were essentially the same as for PG30 with the following exceptions. The 5' oligonucleotide primer sequence was GCGCGAATTCATGAAA-CAACTAAACATTATCAGC, (SEQ ID NO: 577) the 3' oligonucleotide primer sequence was GCGTGCGGCCGCGAAATTGATCTTTGTACCGACGA (SEQ ID NO: 578) and DNA was amplified with the Tth XL PCR kit. The PCR product was cloned into the expression plasmid pET24a using the Eco RI and Not I restriction sites and transformed into E. coli BL21DE3. Expression studies and immunoreactivity studies were carried out on whole E. coli lysates. Purification was not done for these studies.

PG36

The methods used for PG36 were essentially the same as for PG30 with the following exceptions. The 5' oligonucleotide primer sequence was AAAGGAATTCTACAAAAA-GATTATTGCCGTAGCA, (SEQ ID NO: 579) the 3' oligonucleotide primer sequence was CTATGCGGCCGCGAACTCCTGTCCGAGCACAAAGT (SEQ ID NO: 580) and DNA was amplified with the Tth XL PCR kit. The PCR product was cloned into the expression plasmid pET24a using the Eco RI and Not I restriction sites and transformed into E. coli BL21DE3. Expression studies and immunoreactivity studies were carried out on whole E. coli lysates. Purification was not done for these studies.

PG37

The methods used for PG37 were essentially the same as for PG30 with the following exceptions. The 5' oligonucleotide primer sequence was TGGCGAATTCAAACG-GTTTTTGATTTTGATCGGC, (SEQ ID NO: 581) the 3' oligonucleotide primer sequence was CTATGCGGCCGCCTTGCTAAAGCCCATCTTGCTCAG (SEQ ID NO: 582) and DNA was amplified with the Tth XL PCR kit. The PCR product was cloned into the expression plasmid pET24a using the Eco RI and Not I restriction sites and transformed into E. coli BL21DE3. Expression studies and immunoreactivity studies were carried out on whole E. coli lysates. Purification was not done for these studies.

PG38

The methods used for PG38 were essentially the same as for PG30 with the following exceptions. The predicted N-terminal signal sequence was removed from the recombinant protein. The 5' oligonucleotide primer sequence was CCTC-GAATTCCAAAAGGTGGCAGTGGTAAACACT, (SEQ ID NO: 583) the 3' oligonucleotide primer sequence was CTATGCGGCCGCCTTGATTCCGAGTTTCGCTTTTAC (SEQ ID NO: 584) and DNA was amplified with the Tth XL PCR kit. The PCR product was cloned into the expression plasmid pET24a using the Eco RI and Not I restriction sites and transformed into E. coli BL21DE3. Expression studies and immunoreactivity studies were carried out on whole E. coli lysates. Purification was not done for these studies.

PG39

The methods used for PG39 were essentially the same as for PG30 with the following exceptions. The predicted N-terminal signal sequence was removed from the recombinant protein. The 5' oligonucleotide primer sequence was AGCTGGATCCCAAGGCGTCAGGGTATCGGGCTAT, (SEQ ID NO: 585) the 3' oligonucleotide primer sequence was CTATGCGGCCGCGAATTCGACGAG-GAGACGCAGGT (SEQ ID NO: 586) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG40

The methods used for PG40 were essentially the same as for PG30 with the following exceptions. The predicted N-terminal signal sequence was removed from the recombinant protein. The 5' oligonucleotide primer sequence was GGCT-GAATTCAAGACGGACAACGTCCCGACAGAT, (SEQ ID NO: 587) the 3' oligonucleotide primer sequence was CTATGCGGCCGCGAAGTTGACCATAACCTTACCCA (SEQ ID NO: 588) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG41

The methods used for PG41 were essentially the same as for PG30 with the following exceptions. The predicted N-terminal signal sequence was removed from the recombinant protein. The 5' oligonucleotide primer sequence was GACT-GAATTCCAAAACGCCTCCGAAACGACGGTA, (SEQ ID NO: 589) the 3' oligonucleotide primer sequence was CTATGCGGCCGCTTGTTCGGGAATCCCCATGCCGTT (SEQ ID NO: 590) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG42

The methods used for PG42 were essentially the same as for PG30 with the following exceptions. The 5' oligonucleotide primer sequence was GTTTGAATTCG-CAAATAATACTCTTTTGGCGAAG, (SEQ ID NO: 591) the 3' oligonucleotide primer sequence was GAGTGCGGC-CGCTTTGCCGGACATCGAAGAGATCGTC (SEQ ID NO: 592) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG43

The methods used for PG43 were essentially the same as for PG30 with the following exceptions. The 5' oligonucleotide primer sequence was GCGCGAATTCAAAAAA-GAAAAACTTTGGATTGCG, (SEQ ID NO: 593) the 3' oligonucleotide primer sequence was CTATGCGGCCGCCTTCAAAGCGAAA-GAAGCCTTAAC (SEQ ID NO: 594) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG44

The methods used for PG44 were essentially the same as for PG30 with the following exceptions. The predicted N-terminal signal sequence was removed from the recombinant protein. The 5' oligonucleotide primer sequence was AGC-CGAATTCTGTAAGAAAAATGCTGACACTACC, (SEQ ID NO: 595) the 3' oligonucleotide primer sequence was CTATGCGGCCGCCTTTTTCCCGGGCTTGATCCCGAT (SEQ ID NO: 596) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG45

The methods used for PG45 were essentially the same as for PG30 with the following exceptions. The predicted N-terminal signal sequence was removed from the recombinant protein. The 5' oligonucleotide primer sequence was GACAGGATCCTGCTCCACCACAAAGAATCTGCCG, (SEQ ID NO: 597) the 3' oligonucleotide primer sequence was CTATGCGGCCGCGAAGGGATAGCCGA-CAGCCAAAT (SEQ ID NO: 598) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG46

The methods used for PG46 were essentially the same as for PG30 with the following exceptions. The predicted N-terminal signal sequence was removed from the recombinant protein. The 5' oligonucleotide primer sequence was CTCG-GAATTCCGTTATGTGCCGGACGGTAGCAGA, (SEQ ID NO: 599) the 3' oligonucleotide primer sequence was CTAT-GCGGCCGCGAACGGATAGCCTACTGCAATGT (SEQ ID NO: 600) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG47

The methods used for PG47 were essentially the same as for PG30 with the following exceptions. The predicted N-terminal signal sequence was removed from the recombinant protein. The 5' oligonucleotide primer sequence was CGC-CGAATTCCAAACAGTGGTGACCGGTAAG-GTGATCGATTCAGAA, (SEQ ID NO: 601) the 3' oligonucleotide primer sequence was CTATGCGGCCGCGAAGTTTACAC-GAATACCGGTAGACCAAGTGCGGCC (SEQ ID NO: 602) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG48

The methods used for PG48 were essentially the same as for PG30 with the following exceptions. The predicted N-terminal signal sequence was removed from the recombinant protein. The 5' oligonucleotide primer sequence was TGCTGAATTCCAAAAATCCAAGCAGGTACAGCGA, (SEQ ID NO: 603) the 3' oligonucleotide primer sequence was CTATGCGGCCGCTCGTAACCATAGTCTTGGGTTTTTG (SEQ ID NO: 604) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG49

The methods used for PG49 were essentially the same as for PG30 with the following exceptions. The predicted N-terminal signal sequence was removed from the recombinant protein. The 5' oligonucleotide primer sequence was GAACGGATCCAACGAGCCGGTGGAAGACAGATCC, (SEQ ID NO: 605) the 3' oligonucleotide primer sequence was GAGTGCGGCCGCTAATCTCGACTTCATACTTGTACCA (SEQ ID NO: 606) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG50

The methods used for PG50 were essentially the same as for PG30 with the following exceptions. The predicted N-terminal signal sequence was removed from the recombinant protein. The 5' oligonucleotide primer sequence was GCTGGGATCCGCGACAGACACTGAGTTCAAGTAC, (SEQ ID NO: 607) the 3' oligonucleotide primer sequence was CTATGCGGCCGCGAACTTCACTACCAAGCCCATGT (SEQ ID NO: 608) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG51

The methods used for PG51 were essentially the same as for PG30 with the following exceptions. The predicted N-terminal signal sequence was removed from the recombinant protein. The 5' oligonucleotide primer sequence was TCTTGAATTCGCGCAAAGTCTTTTCAGCACCGAA, (SEQ ID NO: 609) the 3' oligonucleotide primer sequence was CTATGCGGCCGCACTTTTTCGTGGGATCACTCTCTT (SEQ ID NO: 610) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG52

The methods used for PG52 were essentially the same as for PG30 with the following exceptions. The 5' oligonucleotide primer sequence was AGAAGAATTCAAACGGACAATCCTCCTGACGGCA, (SEQ ID NO: 611) the 3' oligonucleotide primer sequence was CTATGCGGCCGCGAAGTCTTTGCCCTGATAGAAATC (SEQ ID NO: 612) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG53

The methods used for PG53 were essentially the same as for PG30 with the following exceptions. The predicted N-terminal signal sequence was removed from the recombinant protein. The 5' oligonucleotide primer sequence was GGCTGAATTCGCGAATCCCCTTACGGGCCAATCG, (SEQ ID NO: 613) the 3' oligonucleotide primer sequence was CTATGCGGCCGCGTCCGAAAGGCAGCCGTAATAGG (SEQ ID NO: 614) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG54

The methods used for PG54 were essentially the same as for PG30 with the following exceptions. The predicted N-terminal signal sequence was removed from the recombinant protein. The 5' oligonucleotide primer sequence was CGCTGAATTCCAGATTTCGTTCGGAGGGGAACCC, (SEQ ID NO: 615) the 3' oligonucleotide primer sequence was CTATGCGGCCGCCTGCTTCACGATCTTTTGGCTCA (SEQ ID NO: 616) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG55

The methods used for PG55 were essentially the same as for PG30 with the following exceptions. The predicted N-terminal signal sequence was removed from the recombinant protein. The 5' oligonucleotide primer sequence was CGAGGGATCCGAGCTCTCTATTTGCGATGGCGAG, (SEQ ID NO: 617) the 3' oligonucleotide primer sequence was GAGTGCGGCCGCTCTTACCTGACTTCTTGTCACGAAT (SEQ ID NO: 618) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG56

The methods used for PG56 were essentially the same as for PG30 with the following exceptions. The 5' oligonucleotide primer sequence was AAATGGATCCCGAAAAATTTTGAGCTTTTTGATG, (SEQ ID NO: 619) the 3' oligonucleotide primer sequence was CTATGCGGCCGCTTTGATTCGTAATTTTTCCGTATC (SEQ ID NO: 620) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG57

The methods used for PG57 were essentially the same as for PG30 with the following exceptions. The predicted N-terminal signal sequence was removed from the recombinant protein. The 5' oligonucleotide primer sequence was TGCTGGATCCCAAGAGATCTCAGGCATGAATGCA, (SEQ ID NO: 621) the 3' oligonucleotide primer sequence was GAGTGCGGCCGCTCGGCCTCTTTATCTCTACCTTTTC (SEQ ID NO: 622) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG58

The methods used for PG58 were essentially the same as for PG30 with the following exceptions. The predicted N-terminal signal sequence was removed from the recombinant protein. The 5' oligonucleotide primer sequence was CGGTGAATTCCAAACCCCACGAAATACAGAAACC, (SEQ ID NO: 623) the 3' oligonucleotide primer sequence was GAGTGCGGCCGCTGAAAGTCCAGCTAAAACCGGCGAA (SEQ ID NO: 624) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG59

The methods used for PG59 were essentially the same as for PG30 with the following exceptions. The predicted N-terminal signal sequence was removed from the recombinant protein. The 5' oligonucleotide primer sequence was TGCTGAATTCCAACAAGAGAAGCAGGTGTTTCAT, (SEQ ID NO: 625) the 3' oligonucleotide primer sequence was GAGTGCGGCCGCTGAAGATGCTCTTATCGTCCAAACG (SEQ ID NO: 626) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG60

The methods used for PG60 were essentially the same as for PG30 with the following exceptions. The predicted N-terminal signal sequence was removed from the recombinant protein. The 5' oligonucleotide primer sequence was GGCGGAATTCCAGATGCTCAATACTCCTTTCGAG, (SEQ ID NO: 627) the 3' oligonucleotide primer sequence was GAGTGCGGCCGCTGAAGAGGTAGGAGATATTGCAGAT (SEQ ID NO: 628) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG61

The methods used for PG61 were essentially the same as for PG30 with the following exceptions. The predicted N-terminal signal sequence was removed from the recombinant protein. The 5' oligonucleotide primer sequence was AGCAGAATTCCCCGTCTCCAACAGCGAGATAGAT, (SEQ ID NO: 629) the 3' oligonucleotide primer sequence was GAGTGCGGCCGCTGAAATCGATTGTCAGACTACCCAG (SEQ ID NO: 630) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG62

The methods used for PG62 were essentially the same as for PG30 with the following exceptions. The predicted N-terminal signal sequence was removed from the recombinant protein. The 5' oligonucleotide primer sequence was TGCTGAATTCCAGCGGTTTCCGATGGTGCAGGGA, (SEQ ID NO: 631) the 3' oligonucleotide primer sequence was GAGTGCGGCCGCTGAAGTGAAATCCGACACGCAGCTG (SEQ ID NO: 632) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG63

The methods used for PG63 were essentially the same as for PG30 with the following exceptions. The predicted N-terminal signal sequence was removed from the recombinant protein. The 5' oligonucleotide primer sequence was GGCAGAATTCCAAGAAGCAAACACTGCATCTGAC, (SEQ ID NO: 633) the 3' oligonucleotide primer sequence was GAGTGCGGCCGCTGAAAGTGTACGCAACACCCACGCC (SEQ ID NO: 634) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG64

The methods used for PG64 were essentially the same as for PG30 with the following exceptions. The predicted N-terminal signal sequence was removed from the recombinant protein. The 5' oligonucleotide primer sequence was TGCTGAATTCCAGAGTCGTCCTGCTCTTAGACTG, (SEQ ID NO: 635) the 3' oligonucleotide primer sequence was GAGTGCGGCCGCTGAAGCGAACACCGAGACCCACAAA (SEQ ID NO: 636) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG65

The methods used for PG65 were essentially the same as for PG30 with the following exceptions. The predicted N-terminal signal sequence was removed from the recombinant protein. The 5' oligonucleotide primer sequence was GGCCGGATCCATCGGACAAAGCCGCCCGGCACTT, (SEQ ID NO: 637) the 3' oligonucleotide primer sequence was GAGTGCGGCCGCTAAAGCGGTAACCTATGCCCACGAA (SEQ ID NO: 638) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG66

The methods used for PG66 were essentially the same as for PG30 with the following exceptions. The predicted N-terminal signal sequence was removed from the recombinant protein. The 5' oligonucleotide primer sequence was GTTTGAATTCCAAGACGTTATCAGACCATGGTCA, (SEQ ID NO: 639) the 35 3' oligonucleotide primer sequence was GAGTGCGGCCGCTAAAATGAGTG-GAGAGCGTGGCCAT (SEQ ID NO: 640) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG67

The methods used for PG67 were essentially the same as for PG30 with the following exceptions. The predicted N-terminal signal sequence was removed from the recombinant protein. The 5' oligonucleotide primer sequence was GAAC-GAGCTCGCGGAACGTCCTATGGCCGGAGCA, (SEQ ID NO: 641) the 3' oligonucleotide primer sequence was GAGTGCGGCCGCTATACCAAGTATTCGT-GATGGGACG (SEQ ID NO: 642) and DNA was amplified with the Tth XL PCR kit. The PCR product was cloned into the expression plasmid pET24a using the Sac I and Not I restriction sites and transformed into *E. coli* BL21DE3. Expression studies and immunoreactivity studies were carried out on whole *E. coli* lysates. Purification was not done for these studies.

PG68

The methods used for PG68 were essentially the same as for PG30 with the following exceptions. The predicted N-terminal signal sequence was removed from the recombinant protein. The 5' oligonucleotide primer sequence was GCT-TGCGGCCGCCCTTATGAAAGATTTGCAGAT, (SEQ ID NO: 643) the 3' oligonucleotide primer sequence was GGT-GCTCGAGTATACTCAACAAGCACCTTATGCAC (SEQ ID NO: 644) and DNA was amplified with the Tth XL PCR kit. The PCR product was cloned into the expression plasmid pET24a using the Not I and Xho I restriction sites and transformed into *E. coli* BL21DE3. Expression studies and immunoreactivity studies were carried out on whole *E. coli* lysates. Purification was not done for these studies.

PG69

The methods used for PG69 were essentially the same as for PG30 with the following exceptions. The predicted N-terminal signal sequence was removed from the recombinant protein. The 5' oligonucleotide primer sequence was TGCT-GAATTCCAGGAAGGGGAGGGGAGTGCCCGA, (SEQ ID NO: 645) the 3' oligonucleotide primer sequence was GAGTGCGGCCGCTGAAGCTG-TAGCGGGCTTTGAACCA (SEQ ID NO; 646) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG70

The methods used for PG70 were essentially the same as for PG30 with the following exceptions. The predicted N-terminal signal sequence was removed from the recombinant protein. The 5' oligonucleotide primer sequence was CGGTGGATCCTCGCAAATGCTCTTCTCAGAGAAT, (SEQ ID NO: 647) the 3' oligonucleotide primer sequence was GAGTGCGGCCGCTAAACGAAATATC-GATACCAACATC (SEQ ID NO: 648) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG71

The methods used for PG71 were essentially the same as for PG30 with the following exceptions. The predicted N-terminal signal sequence was removed from the recombinant protein. The 5' oligonucleotide primer sequence was TGCT-GAATTCCAGAACAATACCCTCGATGTACAC, (SEQ ID NO: 649) the 3' oligonucleotide primer sequence was GAGT-GCGGCCGCTATFGCCGGTAGGATTTCCTTGTCC (SEQ ID NO: 650) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG72

The methods used for PG72 were essentially the same as for PG30 with the following exceptions. The predicted N-terminal signal sequence was removed from the recombinant protein. The 5' oligonucleotide primer sequence was TGCT-GAATTCGGAGAGCGACTGGAGACGGACAGC, (SEQ ID NO: 651) the 3' oligonucleotide primer sequence was GAGTGCGGCCGCTATGATTGCCTTTCA-GAAAAGCTAT (SEQ ID NO: 652) and DNA was amplified with the Tth XL PCR kit. The PCR product was cloned into the expression plasmid pET24a using the Eco RI and Not I restriction sites and transformed TGCTGAATTCG-GAGAGCGACTGGAGACGGACAGC (SEQ ID NO: 653) into *E. coli* BL21DE3. Expression studies and immunoreactivity studies were carried out on whole *E. coli* lysates. Purification was not done for these studies.

PG73

The methods used for PG73 were essentially the same as for PG30 with the following exceptions. The predicted N-terminal signal sequence was removed from the recombinant protein. The 5' oligonucleotide primer sequence was CGGT-GAATTCCAACAGACAGGACCGGCCGAACGC, (SEQ ID NO: 654) the 3' oligonucleotide primer sequence was GAGTGCGGCCGCTTAAGAAAGGTATCT-GATAGATCAG (SEQ ID NO: 655) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG74

The methods used for PG74 were essentially the same as for PG30 with the following exceptions. The predicted N-terminal signal sequence was removed from the recombinant protein. The 5' oligonucleotide primer sequence was TGCT-GAATTCCAAGAAAATAATACAGAAAAGTCA, (SEQ ID NO: 656) the 3' oligonucleotide primer sequence was GAGTGCGGCCGCTGAGGTTTAATCCTAT-GCCAATACT (SEQ ID NO: 657) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG75

The methods used for PG75 were essentially the same as for PG30 with the following exceptions. The predicted N-terminal signal sequence was removed from the recombinant protein. The 5' oligonucleotide primer sequence was GGCGGGATCCGCTCAGGAGCAACTGAATGTGGTA, (SEQ ID NO: 658) the 3' oligonucleotide primer sequence was GAGTGCGGCCGCTGTGGAACAAATTGCGCAATCCATC (SEQ ID NO: 659) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG76

The methods used for PG76 were essentially the same as for PG30 with the following exceptions. The predicted N-terminal signal sequence was removed from the recombinant protein. The 5' oligonucleotide primer sequence was AGCAGAATTCGGAAACGCACAGAGCTTTTGGGAA, (SEQ ID NO: 660) the 3' oligonucleotide primer sequence was GAGTGCGGCCGCTTACCTGCACCTTATGACTGAATAC (SEQ ID NO; 661) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG77

The methods used for PG77 were essentially the same as for PG30 with the following exceptions. The predicted N-terminal signal sequence was removed from the recombinant protein. The 5' oligonucleotide primer sequence was TGCTGAATTCCAAGAGAAAAAGGATAGTCTCTCT, (SEQ ID NO: 662) the 3' oligonucleotide primer sequence was GAGTGCGGCCGCTCTTICTFATCGCCATAGAATACAGG (SEQ ID NO: 663) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG78

The methods used for PG78 were essentially the same as for PG30 with lo the following exceptions. The predicted N-terminal signal sequence was removed from the recombinant protein. The 5' oligonucleotide primer sequence was GGCAGAATTCCAGGATTCTTCCCACGGTAGCAAT, (SEQ ID NO: 664) the 3' oligonucleotide primer sequence was GAGTGCGGCCGCTATCATGATAGTAAAGACTGGTTCT (SEQ ID NO: 665) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG79

The methods used for PG79 were essentially the same as for PG30 with the following exceptions. The 5' oligonucleotide primer sequence was TGCTGAATTCGTAGTGACGCTGCTCGTAATTGTC, (SEQ ID NO: 666) the 3' oligonucleotide primer sequence was GAGTGCGGCCGCTGCCGTCCTGCCTTTCTGCCTGACG (SEQ ID NO; 667) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG80

The methods used for PG80 were essentially the same as for PG30 with the following exceptions. The predicted N-terminal signal sequence was removed from the recombinant protein. The 5' oligonucleotide primer sequence was GGCCGAATTCCAAAACGTGCAGTTGCACTACGAT, (SEQ ID NO: 668) the 3' oligonucleotide primer sequence was GAGTGCGGCCGCTGTTGAAAGTCCATTTGACCGCAAG (SEQ ID NO: 669) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG81

The methods used for PG81 were essentially the same as for PG30 with the following exceptions. The predicted N-terminal signal sequence was removed from the recombinant protein. The 5' oligonucleotide primer sequence was GTTTGAATTCCAGGATTTTCTCTATGAAATAGGA, (SEQ ID NO: 670) the 3' oligonucleotide primer sequence was GAGTGCGGCCGCTTTGTTTATTACAAAAAGTCTTACG (SEQ ID NO: 671) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG82

The methods used for PG82 were essentially the same as for PG30 with the following exceptions. The predicted N-terminal signal sequence was removed from the recombinant protein. The 5' oligonucleotide primer sequence was GAACGAATTCCAGAACAACAACTTTACCGAGTCG, (SEQ ID NO: 672) the 3' oligonucleotide primer sequence was GAGTGCGGCCGCTGTTCAGTTTCAGCTTTTTAAACCA (SEQ ID NO: 673) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG84

The methods used for PG84 were essentially the same as for PG30 with the following exceptions. The predicted N-terminal signal sequence was removed from the recombinant protein. The 5' oligonucleotide primer sequence was TGCTGGATCCCAGAATGATGACATCTTCGAAGAT, SEQ ID NO: 674) the 3' oligonucleotide primer sequence was GAGTGCGGCCGCTATTGCGTCCCCGGC- CACTACGTCC (SEQ ID NO: 675) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG85

The methods used for PG85 were essentially the same as for PG30 with the following exceptions. The predicted N-terminal signal sequence was removed from the recombinant protein. The 5' oligonucleotide primer sequence was CGGTGAATTCGTACCAACGGACAGCACGGAATCG, (SEQ ID NO: 676) the 3' oligonucleotide primer sequence was GAGTGCGGCCGCTCAGATTGGTGCTATAAGAAAGGTA (SEQ ID NO: 677) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG86

The methods used for PG86 were essentially the same as for PG30 with the following exceptions. The predicted N-terminal signal sequence was removed from the recombinant protein. The 5' oligonucleotide primer sequence was TGCTGGATCCCAAACGCATGATCATCTCATCGAA, (SEQ ID NO: 678) the 3' oligonucleotide primer sequence was GAGTGCGGCCGCTGTGGTTCAGGCCGTGGGCAAATCT (SEQ ID NO: 679) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG87

The methods used for PG87 were essentially the same as for PG30 with the following exceptions. The predicted N-terminal signal sequence was removed from the recombinant protein. The 5' oligonucleotide primer sequence was GGCGGAATTCCAGAGCTATGTGGACTACGTCGAT, (SEQ ID NO: 680) the 3' oligonucleotide primer sequence was GAGTGCGGCCGCTATTACTGTGATTAGCGCGACGCTG (SEQ ID NO: 681) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG88

The methods used for PG88 were essentially the same as for PG30 with the following exceptions. The predicted N-terminal signal sequence was removed from the recombinant protein. The 5' oligonucleotide primer sequence was AGCAGAATTCGCCGAATCGAAGTCTGTCTCTTTC, (SEQ ID NO: 682) the 3' oligonucleotide primer sequence was GAGTGCGGCCGCTCGGCAAGTAACGCTTTAGTGGGA (SEQ ID NO: 683) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG89

The methods used for PG89 were essentially the same as for PG30 with the following exceptions. The predicted N-terminal signal sequence was removed from the recombinant protein. The 5' oligonucleotide primer sequence was TGCTGAATTCCAATCGAAGTTAAAGATCAAGAGC, (SEQ ID NO: 684) the 3' oligonucleotide primer sequence was GAGTGCGGCCGCTATTAGTCCAAAGACCCACGGTAAA (SEQ ID NO: 685) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG90

The methods used for PG90 were essentially the same as for PG30 with the following exceptions. The predicted N-terminal signal sequence was removed from the recombinant protein. The 5' oligonucleotide primer sequence was GGCAGAATTCCAAACAACGACGAACAGTAGCCGG, (SEQ ID NO: 686) the 3' oligonucleotide primer sequence was GAGTGCGGCCGCTTTTTTGTGATACTGTTTGGGC (SEQ ID NO: 687) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG91

The methods used for PG91 were essentially the same as for PG30 with the following exceptions. The predicted N-terminal signal sequence was removed from the recombinant protein. The 5' oligonucleotide primer sequence was TGCTGAATTCCAGACGATGGGAGGAGATGATGTC, (SEQ ID NO: 688) the 3' oligonucleotide primer sequence was GAGTGCGGCCGCTTTCCACGATGAGCTTCTCTACGAA (SEQ ID NO: 689) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG92

The methods used for PG92 were essentially the same as for PG30 with the following exceptions. The predicted N-terminal signal sequence was removed from the recombinant protein. The 5' oligonucleotide primer sequence was GGCCGAATTCGCCGATGCACAAAGCTCTGTCTCT, (SEQ ID NO: 690) the 3' oligonucleotide primer sequence was GAGTGCGGCCGCTTCGAGGACGATTGCTTAGTTCGTA (SEQ ID NO: 691) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG93

The methods used for PG93 were essentially the same as for PG30 with the following exceptions. The predicted N-terminal signal sequence was removed from the recombinant protein. The 5' oligonucleotide primer sequence was GGCCGAGCTCCAAGAGGAAGGTATTTGGAATACC, (SEQ ID NO: 692) the 3' oligonucleotide primer sequence was GAGTGCGGCCGCTGCGAATCACTGC- GAAGCGAATTAG (SEQ ID NO: 693) and DNA was amplified with the Tth XL PCR kit. The PCR product was cloned into the expression plasmid pET24a using the Sac I and Not I restriction sites and transformed into *E. coli* BL21DE3. Expression studies and immunoreactivity studies were carried out on whole *E. coli* lysates. Purification was not done for these studies.

PG94

The methods used for PG94 were essentially the same as for PG30 with the following exceptions. The predicted N-terminal signal sequence was removed from the recombinant protein. The 5' oligonucleotide primer sequence was GGC-CGAGCTCCAAGAGGAAGGTATTTGGAATACC, (SEQ ID NO: 694) the 3' oligonucleotide primer sequence was GAGTGCGGCCGCTTTGTCCTACCACGAT-CATTTTCTT (SEQ ID NO: 695) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG95

The methods used for PG95 were essentially the same as for PG30 with the following exceptions. The predicted N-terminal signal sequence was removed from the recombinant protein. The 5' oligonucleotide primer sequence was GGC-CGAGCTCTGTGGAAAAAAAGAAAAACACTCT, (SEQ ID NO: 696) the 3' oligonucleotide primer sequence was GAGTGCGGCCGCTAACTGTCTCCT-TGTCGCTCCCCGG (SEQ ID NO: 697) and DNA was amplified with the Tth XL PCR kit. The PCR product was cloned into the expression plasmid pET24a using the Sac I and Not I restriction sites and transformed into *E. coli* BL21DE3. Expression studies and immunoreactivity studies were carried out on whole *E. coli* lysates. Purification was not done for these studies.

PG96

The methods used for PG96 were essentially the same as for PG30 with the following exceptions. The predicted N-terminal signal sequence was removed from the recombinant protein. The 5' oligonucleotide primer sequence was TGCT-GAGCTCCAAACGCAAATGCAAGCAGACCGA, (SEQ ID NO: 698) the 3' oligonucleotide primer sequence was GAGTGCGGCCGCTTTTGAGAATTTTCAT-TGTCTCACG (SEQ ID NO: 699) and DNA was amplified with the Tth XL PCR kit. The PCR product was cloned into the expression plasmid pET24a using the Sac I and Not I restriction sites and transformed into *E. coli* BL21DE3. Expression studies and immunoreactivity studies were carried out on whole *E. coli* lysates. Purification was not done for these studies.

PG97

The methods used for PG97 were essentially the same as for PG30 with the following exceptions. The predicted N-terminal signal sequence was removed from the recombinant protein. The 5' oligonucleotide primer sequence was GGCGGGATCCCAGTTTGTTCCGGCTCCCACCACA, (SEQ ID NO: 700) the 3' oligonucleotide primer sequence was GAGTGCGGCCGCTCTGTTTGATGAGCT-TAGTGGTATA (SEQ ID NO: 701) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

PG98

The methods used for PG98 were essentially the same as for PG30 with the following exceptions. The predicted N-terminal signal sequence was removed from the recombinant protein. The 5' oligonucleotide primer sequence was AGCA-GAATTCCAAGAAAGAGTCGATGAAAAAGTA, (SEQ ID NO: 702) the 3' oligonucleotide primer sequence was GAGTGCGGCCGCTTAGCTGTGTAACAT-TAAGTTTTTTATTGAT (SEQ ID NO: 703) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG99

The methods used for PG99 were essentially the same as for PG30 with the following exceptions. The predicted N-terminal signal sequence was removed from the recombinant protein. The 5' oligonucleotide primer sequence was TGCT-GAATTCAAGGACAATTCTTCTTACAAACCT, (SEQ ID NO: 704) the 3' oligonucleotide primer sequence was GAGT-GCGGCCGCTTCGAATCACGACTTTTCTCACAAA (SEQ ID NO: 705) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG100

The methods used for PG100 were essentially the same as for PG30 with the following exceptions. The predicted N-terminal signal sequence was removed from the recombinant protein. The 5' oligonucleotide primer sequence was GGCA-GAATTCCAGTCTTTGAGCACAATCAAAGTA, (SEQ ID NO: 706) the 3' oligonucleotide primer sequence was GAGT-GCGGCCGCTGATAGCCAGCTTGATGCTCTTAGC (SEQ ID NO: 707) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG101

The methods used for PG101 were essentially the same as for PG30 with the following exceptions. The 5' oligonucleotide primer sequence was TGCTGAATTCAAAG-GCAAGGGCGATCTGGTCGGG, (SEQ ID NO: 708) the 3' oligonucleotide primer sequence was GAGTGCGGCCGCT-TCTCTTCTCGAACTTGGCCGAGTA (SEQ ID NO; 709) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG102

The methods used for PG102 were essentially the same as for PG30 with the following exceptions. The predicted N-terminal signal sequence was removed from the recombinant protein. The 5' oligonucleotide primer sequence was GGC- CGAATTCCAGATGGATATTGGTGGAGACGAT, (SEQ ID NO: 710) the 3' oligonucleotide primer sequence was GAGTGCGGCCGCTCTCTACAAT-GATTTTTTCCACGAA (SEQ ID NO: 711) and DNA was amplified with the Tth XL PCR kit. The PCR product was cloned into the expression plasmid pET24a using the Eco RI and Not I restriction sites and transformed into *E. coli* BL21DE3. Expression studies and immunoreactivity studies were carried out on whole *E. coli* lysates. Purification was not done for these studies.

PG104

The methods used for PG104 were essentially the same as for PG30 with the following exceptions. The predicted N-terminal signal sequence was removed from the recombinant protein. The 5' oligonucleotide primer sequence was GAACGGATCCAACGTGTCTGCTCAGTCACCCCGA, (SEQ ID NO: 712) the 3' oligonucleotide primer sequence was GAGTGCGGCCGCTTCTGAGC-GATACTTTTGCACGTAT (SEQ ID NO: 713) and DNA was amplified with the Tth XL PCR kit. The PCR product was cloned into the expression plasmid pET24a using the Bam HI and Not I restriction sites and transformed into *E. coli* BL21DE3. Expression studies and immunoreactivity studies were carried out on whole *E. coli* lysates. Purification was not done for these studies.

Animal Antisera and Human Patient Sera.

Various antisera were raised for detecting the expression and refolding of the recombinant *P. gingivalis* proteins. A whole cell antisera was raised by injecting New Zealand White rabbits with 3 doses of sonicated *P. gingivalis* (strain W50) containing approximately 2 mg of protein. The first dose was given in Freunds complete adjuvant (FCA) and the second and third doses were given in Freunds incomplete adjuvant (IFA) at 3 week intervals. Doses (1 ml) were given intramuscularly into the hind legs and rabbits bled 7 days after the last dose, the blood clotted and serum removed and stored at −20° C. until required. A second rabbit antisera was produced in a similar manner but using a sarkosyl insoluble fraction (each dose was 0.69 mg of protein) derived from *P. gingivalis* W50 according to the method of Doidg and Trust T. et al 1994 as the immunogen. A third rabbit antisera was produced in a similar manner to the first only the sarkosyl soluble fraction (1 mg of protein per dose) derived from *P. gingivalis* W50 cells according to the method of Doidg P. and Trust T J. (1994 Infect Immun 62:4526-33) was used as the immunogen.

A "protected rat serum" pool was also used in these studies and was obtained from rats immunised with formalin killed whole *P. gingivalis* cells in FIA (strain ATCC 33277; 2 doses of $2 \times 10^9$ cells, 3 weeks apart). Rats were then challenged 2 weeks after their last dose with live *P. gingivalis* cells (strain 33277) given orally as previously described (Klaussen B. et al. 1991, Oral Microbiol Immunol 6:193-201) and the serum obtained from these rats 6 weeks after the final challenge inoculation at the time of sacrifice.

Human sera were obtained from adult patients undergoing treatment or assessment for periodontitis at an outpatient clinic. These patients had at least 6 teeth with 6 mm attachment loss and had *P. gingivalis* present in their sub-gingival plaque as detected using a *P. gingivalis* specific DNA probe. Sera was pooled from these patients and compared to a pool of sera from periodontally healthy patients.

Immunization and Murine Lesion Model Protocols

The mouse abscess model was used to assess the efficacy of immunising mice with recombinant *P. gingivalis* proteins in protecting mice from formation of a subcutaneous abscess. This model has been used by others as a predictor of potential vaccines against periodontal disease (Bird P S, et al. 1995 J. Periodontol. 66:351-362. BALB/c mice 6-8 weeks old were immunised by subcutaneously injecting them with 0.1 ml containing either 10 or 20 µg of recombinant *P. gingivalis* protein, 20 µg of *E. coli* lysate protein, $2 \times 10^9$ formalin killed cells of *P. gingivalis* strain 33277 emulsified in incomplete Freund's adjuvant (IFA; Sigma) on day 0. At day 21 mice were re-injected with the same dose and then bled 1 week later and evaluated for antibody levels. At day 35 mice all mice were challenged with approximately $2 \times 10^9$ cells of live *P. gingivalis* (ATCC 33277) by subcutaneous injection in the abdomen. Following challenge mice were monitored daily for weight loss and the size of the lesion measured for the next 10 days. Lesion sizes were measured by length and width and expressed as $mm^2$. Groups were statistically analysed using a Kruskal-Wallis one-way ANOVA and were also individually examined using the unpaired t test or Mann-Whitney rank sum test using the Instat statistical package.

IMMUNOSCREENING

Figure 1:
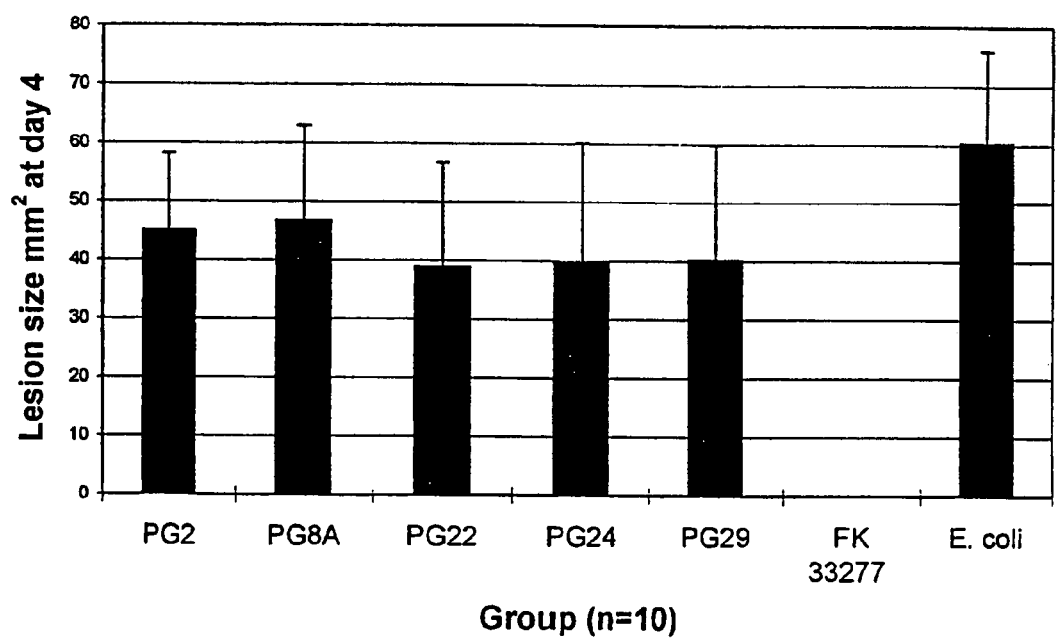
FIG. 1 shows the results of one experiment at day 4 after challenge (lesions were at maximum size at this time point). Control mice immunised with *E. coli* lysate showed large lesions while mice immunised with killed cells of *P. gingivalis* strain 33277 were fully protected. This indicates that whole cells provide protection against *P. gingivalis* while *E. coli* protein immunised mice were not protected. Mice given the various PG recombinant proteins showed significant levels of protection for PG2, PG22, PG24 and PG29 (p<0.05 unpaired t test) while PG8A was not quite significantly different (p=0.07) compared to the *E. coli* control group.
Figure 2:
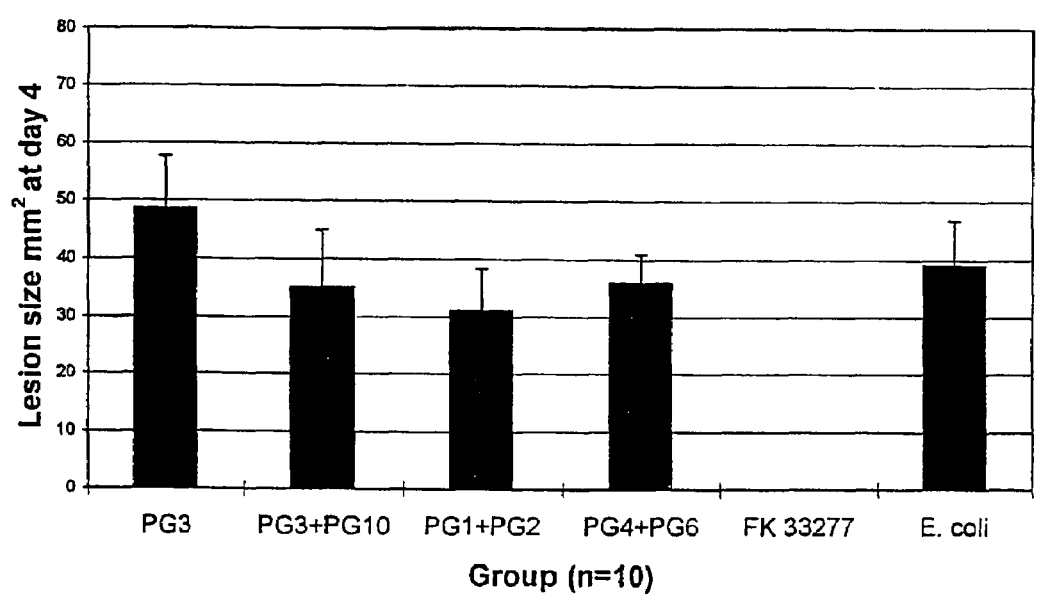
FIG. 2 shows the results of a separate experiment using combinations of recombinant proteins. Mice given PG1+PG2 showed a significant level of protection compared to control mice give *E. coli* lysate (p<0.026 unpaired t test).

Cloned candidates were cultured in 15 ml of Terrific broth, induced with IPTG and sampled at 4 h post-induction. One ml of culture was removed, pelleted and the cells resuspended in a volume of PBS determined by dividing the OD $A_{600\ nm}$ of the culture by 8. An aliquot of lysate (100 µl) was added to 100 µl of 2× sample reducing buffer (125 mM Tris pH 6.8, 20% glycerol, 4% SDS, 80 mM DTT, 0.03% bromophenol blue) and boiled for 10 min. SDS-PAGE was performed according to the method of Laemmli UK. 1970 (Nature 227:680-685) using 4-20% 1.0 mm Tris-Glycine gels (Novex) according to the manufacturers recommendations. Proteins were transferred onto Hybond-C Extra nitrocellulose membranes (Amersham) by transblotting and the membranes were then blocked for 2 h at room temperature (RT) in 5% skim milk in 20 mM Tris, 0.5M NaCl, 0.05% Tween-20, pH 7.5 (TTBS).

Immunoscreening was performed separately with the rabbit anti-*P. gingivalis* whole cell serum, the rat protective serum, a pool of human periodontal patients serum, and in many cases an anti-T7-Tag antibody HRP conjugate (Novagen). Prior to use, the rabbit, rat and human sera were diluted 1/5000, 1/1000 and 1/500 respectively in 5% skim milk in TTBS and absorbed with 100 µl (for the rabbit serum) or 250 µl (for the rat and human sera) *E. coli* extract (20 mg/ml; Promega) for 6 h at RT.

Membranes were incubated overnight at RT with the absorbed antisera, or for 1 hr at RT with 1/5000 diluted anti-T7-Tag conjugate. Following 3×10 min washes with TTBS, HRP-conjugated anti-rabbit (Silenus), anti-mouse (Silenus) or anti-human (KPL) antibody, diluted 1/5000 in 5% skim milk in TTBS, was added for 1 h at RT. Membranes were washed as before, prior to addition of TMB membrane peroxidase substrate (KPL) for detection of immunoreactive proteins. Results of reactivity for the recombinant P. gingivalis proteins is shown in Table 7.

In addition some of the sera (pooled sera diluted 1/1000) from the mice immunised with P. gingivalis recombinant proteins (prior to challenge) were analysed for their reactivity against Western blots of whole native W50 P. gingivalis proteins using similar techniques as those outlined above. PG2, PG8A, PG29 and PG3 all showed bands at a similar molecular weight to that of the recombinant PG protein in the native W50 blot. This indicates that PG proteins are expressed in the W50 strain and that the recombinant proteins have at least some identical immunogenicity to the native proteins.

m-RNA Analysis

Hot Phenol RNA Extraction

P. gingivalis W50 cells (150ml culture) were grown anaerobically to mid log phase (OD $A_{600}$=0.18) mixed with 50% glycerol and stored at −70° C. until RNA extraction. Cells were pelleted by centrifugation at 600 g, and resuspended in 8 ml ASE (20 mM NaOAc, 0.5% SDS, 1 mM EDTA). An equal volume of 20 mM NaOAc(pH 4.5)-saturated phenol was added and mixed by shaking for 30 seconds, incubated at 65° C. for 5 minutes, followed by a further 5 second shaking and repeated incubation. After cooling, 2 ml chloroform was added and mixed by shaking for 5 seconds, and the mixture spun at 10000 g for 10 minutes at 4° C. The top aqueous phase was transferred and re-extracted by repeating the phenol and chloroform steps. The aqueous phase was transferred again and 100 U RNase inhibitor (RNAsin; Promega) were added. RNA was precipitated with 3 volumes 100% ethanol at −20° C. overnight. The RNA precipitate was recovered by centrifugation at 10000 g at 4° C. for 15 minutes, then washed with 100% ethanol, dried and resuspended in 600 μl sterile, deionised, $dH_2O$ with 1 μl of fresh RNase inhibitor. RNA was aliquoted and stored at −70° C. The RNA concentration was determined spectrophotometrically. A formaldehyde RNA gel confirmed RNA integrity (Sambrook J. et al. 1989, Molecular Cloning. A laboratory manual. Cold Spring Laboratory Press, New York. 2nd Edition).

RT-PCR

The isolated RNA was used as a template for Reverse Transcription (RT) to produce cDNA. Varying RNA concentrations were used for the RT as each RNA transcript was potentially present at different levels. Subsequent amplification of the cDNA was performed using Polymerase Chain Reaction (PCR). RT-PCR was performed using GeneAmp® RNA PCR Kit (Perkin Elmer) according to the manufacturer's protocol with the following exception to the PCR; 35 cycles were performed as follows: Melt phase 95° C. for 30 seconds, Anneal phase varied between 50-60° C. for 30 seconds, Extension phase 72° C. for 1 minute. Amplification was performed in a PTC-100 Programable Thermal Controller (MJ Research Inc.). As a control to demonstrate that the amplified product did not arise from contaminating DNA, Reverse Transcriptase (RTase) was omitted from a parallel tube. The PCR products were examined against DNA markers (GIBCO 1 kB ladder) on a 1% agarose gel stained with ethidium bromide.

RT-PCR results are shown in Table 6 using the oligonucleotide primers as used in "Cloning, expression and purification of recombinant P. gingivalis genes" section described above, except for the following changes. For PG1 the 3' reverse primer used was GCGCCTCGAGATTCATTTCCTTATA-GAG, (SEQ ID NO: 714) for PG4 the 5' forward primer was CTTCTTGTCGACTACAGCGGACATCATAAAATC (SEQ ID NO: 715) and the 3' reverse primer was TTCCAC-CTCGAGTTAACGCAACTCTTCTTCGAT, (SEQ ID NO: 716) for PG6 the 5' forward primer was TAAAGAATTCT-GCCTCGAACCCATAATTGCTCCG, (SEQ ID NO: 717) for PG10 the 5' forward primer was CGCGCATATG-GATAAAGTGAGCTATGC (SEQ ID NO: 718) and the 3' reverse primer was CGCGCTCGAGTTTGTTGATACT-CAATAATTC, (SEQ ID NO: 719) for PG13 the 5' forward primer was GCCCGGCGCCATGCGGACAAAAAC-TATCTTTTTTGCG (SEQ ID NO: 720) and the 3' reverse primer was GCCCGGCGCCTTAGTTGTTGAATC-GAATCGCTATTTGAGC (SEQ ID NO: 721).

Amplification of P. gingivalis transcripts is a likely indication that RNA for a specific candidate is present and that the protein is produced. However, where there is no amplification achieved this does not indicate that this gene is never transcribed and may be the result of the culture conditions or the state of the cells when harvested.

TABLE 6

Expression of PG m-RNA with in vitro grown P. gingivalis W50.

| PG # | RNA μg | Annealing temp. °C. | RT-PCR | PCR (−RT) | Approx. fragment size bp | Expected fragment size bp |
|---|---|---|---|---|---|---|
| 1 | 0.15 | 55 | + | − | 1300 | 1362 |
| 2 | 1.0 | 50 | + | − | 3200 | 3051 |
| 3 | 0.15 | 60 | + | − | 720 | 690 |
| 4 | 2.9 | 55 | − | − | N.D. | 2000 |
| 5 | 0.02 | 50 | + | − | 1000 | 947 |
| 6 | 1.0 | 55 | + | − | 1000 | 972 |
| 8A | 0.15 | 50 | + | − | 1200 | 1278 |
| 10 | 0.15 | 55 | + | − | 590 | 585 |
| 11 | 0.10 | 60 | + | − | 960 | 942 |
| 12 | 0.02 | 60 | + | − | 880 | 831 |
| 13 | 1.0 | 50 | + | − | 2150 | 2274 |
| 14 | 0.15 | 60 | + | − | 1050 | 996 |
| 22 | 1.0 | 60 | − | − | N.D. | 228 |
| 24 | 1.0 | 55 | + | + | 1150 | 1194 |
| 29 | 0.15 | 60 | + | − | 880 | 885 |

The symbols are + band visible on agarose gel, − no band present on agarose gel, ND not detected.

TABLE 7

Immunoblot results of proteins expressed in E. coli against rabbit, rat and human antisera. Deduced MW was calculated from amino acid sequence of the P. gingivalis proteins, some of which had their N-terminal signal sequences removed. Apparent MW was determined from SDS-PAGE gels. The N- and C- terminal tags add approximately 2.5 KDa to the deduced MW of the recombinant proteins.

| Protein number | Deduced MW (KDa) | Apparent MW (KDa) | Antisera reactivity | | |
|---|---|---|---|---|---|
| | | | T7 | Rabbit | Rat | Human |
| PG1 | 47.5 | 63 | ND | − | − | − |
| PG2 | 112.4 | 125.7 | ND | + | − | − |
| PG3 | 22.6 | 18.3 | ND | −[a] | − | − |
| PG4 | 75 | 90.6 | ND | − | − | − |
| PG5 | 34.9 | 43.8 | ND | − | − | − |
| PG6 | 36.7 | 47.1 | ND | − | − | − |
| PG8 | 67.5 | 63.1 | ND | −[b] | − | − |
| PG8A | 47.7 | 90.6 | ND | − | − | − |
| PG10 | 21.3 | 25.5 | ND | + | − | + |

TABLE 7-continued

Immunoblot results of proteins expressed in *E. coli* against rabbit, rat and human antisera. Deduced MW was calculated from amino acid sequence of the *P. gingivalis* proteins, some of which had their N-terminal signal sequences removed. Apparent MW was determined from SDS-PAGE gels. The N- and C- terminal tags add approximately 2.5 KDa to the deduced MW of the recombinant proteins.

| Protein number | Deduced MW (KDa) | Apparent MW (KDa) | T7 | Rabbit | Rat | Human |
|---|---|---|---|---|---|---|
| PG11 | 36.2 | 42.4 | ND | − | − | − |
| PG12 | 30.7 | 30.6 | ND | − | − | − |
| PG13 | 84.5 | 101 | ND | − | − | − |
| PG14 | 36 | 42.4 | ND | − | + | + |
| PG22 | 8.6 | 11.1 | ND | − | − | − |
| PG24A | 47 | 63.1 | ND | − | − | − |
| PG29 | 31.1 | 40.9 | ND | + | + | + |
| PG30 | 35.1 | 46.9 | + | − | − | − |
| PG31 | 16.7 | — | − | − | − | − |
| PG32 | 41.2 | 59.5 | + | + | + | − |
| PG33 | 39.9 | 52.7 | + | + | + | − |
| PG35 | 92.6 | 116.6 | + | − | − | − |
| PG36 | 98.9 | 120.2 | − | − | − | − |
| PG37 | 18.8 | 23.1 | + | + | − | − |
| PG38 | 16.1 | 22.9 | + | − | − | − |
| PG39 | 87.9 | 116.6 | + | − | − | − |
| PG40 | 76.6 | 103.1 | + | − | − | − |
| PG41 | 48.3 | 81.1 | + | − | + | + |
| PG42 | 59.3 | 73.9 | + | − | − | − |
| PG43 | 27.1 | 50.3 | + | − | − | − |
| PG44 | 28.6 | 32.3 | + | − | + | − |
| PG45 | 84 | 100.6 | + | − | − | − |
| PG46 | 83 | 97.7 | + | − | − | − |
| PG47 | 93.7 | 42.5 | + | + | − | + |
| PG48 | 45.2 | 37.9 | + | − | − | − |
| PG49 | 33.3 | 64.1 | + | − | + | − |
| PG50 | 91.9 | 113.2 | + | + | − | − |
| PG51 | 19.6 | 27.2 | + | − | − | − |
| PG52 | 50.4 | 64.4 | + | + | − | + |
| PG53 | 47.4 | 45.4 | + | − | − | + |
| PG54 | 101.4 | 46.7 | + | + | − | − |
| PG55 | 70.4 | 68.4 | + | − | − | − |
| PG56 | 142.3 | — | − | − | − | − |
| PG57 | 100 | 134.5 | + | + | + | + |
| PG58 | 63 | 82.9 | + | − | − | − |
| PG59 | 33.3 | 43.6 | + | − | − | − |
| PG60 | 55.6 | 77.8 | + | − | − | − |
| PG61 | 81.5 | 107.3 | + | − | − | − |
| PG62 | 51.9 | 58.4 | + | − | − | − |
| PG63 | 29.6 | 43.6 | + | − | − | − |
| PG64 | 18.5 | 26.9 | + | − | − | − |
| PG65 | 25.9 | 28.8 | + | − | − | − |
| PG66 | 22.2 | 25.1 | + | + | − | − |
| PG67 | 103.7 | 105 | + | − | − | − |
| PG68 | 133.3 | 30.7 | + | − | + | + |
| PG69 | 44.4 | 50.8 | + | − | − | − |
| PG70 | 25.9 | 30.8 | + | − | − | − |
| PG71 | 88.9 | 105.5 | + | − | − | − |
| PG72 | 40.7 | 49.8 | + | − | − | − |
| PG73 | 40.7 | 29 | +/− | − | − | − |
| PG74 | 22.2 | 32.5 | + | − | − | − |
| PG75 | 40.7 | 46.7 | + | − | − | − |
| PG76 | 48.1 | 55.6 | + | − | − | + |
| PG77 | 29.6 | 36.9 | + | − | − | − |
| PG78 | 33.3 | 35.4 | + | − | − | − |
| PG79 | 33.3 | — | − | − | − | − |
| PG80 | 25.9 | 20.5 | + | − | − | − |
| PG81 | 23 | 25.8 | + | − | − | − |
| PG82 | 44.8 | 48.5 | + | − | − | − |
| PG84 | 41.7 | 52.4 | + | − | − | +/− |
| PG85 | 62.7 | 72.4 | + | − | − | − |
| PG86 | 21.7 | 27.4 | + | − | − | +/− |
| PG87 | 83 | 91.3 | + | − | − | + |
| PG88 | 27 | 40.1 | + | − | − | − |
| PG89 | 26.2 | 29.4 | + | − | − | − |
| PG90 | 23 | 28.4 | + | − | − | − |
| PG91 | 57.2 | 85.7 | + | + | + | + |
| PG92 | 83.6 | 110.4 | + | − | − | + |
| PG93 | 83.4 | 110.4 | + | − | − | + |
| PG96 | 59.3 | 70.3 | + | + | + | + |
| PG97 | 44.4 | 57.5 | + | − | + | + |
| PG98 | 33.3 | 36 | + | − | − | − |
| PG99 | 40.7 | 55.6 | + | − | + | + |
| PG100 | 29.6 | 10.8 | + | − | − | − |
| PG101 | 14.8 | 19.7, 14.1 | + | − | − | − |
| PG102 | 59.3 | 70.3 | + | − | − | + |
| PG104 | 40.7 | 57.5 | + | − | − | + |

The symbols are + positive, − negative, +/− weak positive, ND not done.
<sup>a</sup>Positive reaction detected with the rabbit antiserum to sarkosyl insoluble *P. gingivalis* antigen.
<sup>b</sup>Purified protien demonstrated weak positive reaction with the rabbit antiserum to whole *P. gingivalis*.

It will be appreciated by persons skilled in the art that numerous variations and/or modifications may be made to the invention as shown in the specific embodiments without departing from the spirit or scope of the invention as broadly described. The present embodiments are, therefore, to be considered in all respects as illustrative and not restrictive.

REFERENCES

1. Lipman D J, Pearson W R. 1985. Rapid and sensitive protein similarity searches. Science 277:1435-1441.
2. Horton, P. and Nakai, K. (1996). A probabilistic classification system for predicting the cellular localization sites of proteins. Intellig. Syst. Mol. Biol. 4:109-115.
3. Nakai K, Kanehisa M. 1991. Expert systems for predicting protein localization sites in Gram-negative bacteria. Proteins: Structure, Function, and Genetics 11:95-110.
4. Nielsen H, Engelbrecht J, Brunak S and von Heijne G. 1997. Identification of prokaryotic and eukaryotic signal peptides and prediction of their cleavage sites. Protein Engineering 10, 1-6.
5. Claros M G and G von Heijne. (1994). TopPred II: an improved software for membrane protein structure predictions. Comput. Appl. Biosci. 10: 685-686.
6. Borodovsky M, Rudd K E, and E V Koonin. (1994). Intrinsic and extrinsic approaches for detecting genes in a bacterial genome. Nucleic Acids Res. 22:4756-4767.
7. Struvye M, Moons M, Tommassen J. 1991. Carboxy-terminal phenylalanine is essential for the correct assembly of a bacterial outer membrane protein J. Mol. Biol. 218:141-148.
8. Aduse-Opoku J, Slaney J M, Rangarajan M, Muir J, Young K A, Curtis M A. 1997. The Tla receptor protein of *Porphyromonas gingivalis* W50: a homolog of the RI precursor (PrpRI) is an outer membrane receptor required for growth on low levels of hemin. J. Bacteriol. 179:4778-4788.
9. Needleman S B, Munsch C D. 1970. Ageneral method applicable to the search of similarity in the amino acid sequence of two proteins. J. Molec. Biol. 48: 443-453.

SEQUENCE LISTING (721 sequences)

SEQ ID NO: 1 - DNA, 1362 bp, Porphyromonas gingivalis
ttctgtgtcatggcaaaagttataaaaacaaaaaaaggccttgcacttaatctgaaaggaaaaccgctgcccgagatgctggccgaaccggcccaaagtcctacttacgcggtcgtgcccgacgattttgaaggtgttatccccaaggtgacggctcgtccgggggataaggtgcgtgccggctcagcactgatgcaccacaaggcatatccggagatgaagtttacaagtccggttagcggcgaagtgatcgcggtgaatcgcggtgccaagcgcaaggtgttgagcatcgaggtgaaaccggacggactgaacgaatacgagtcattccctgtcggggatccgtctgccctctctgccgaacagatcaaggagcttttactgtcgagcggtatgtggggttttattaagcaacgtccttacgacatagtggctacaccggatatagctccacgcgacatttatattactgccaactttactgcaccattggctccggacttcgatttcatcgttcgaggagaagaacgcgccctgcagactgccatcgatgccttggccaaactcacgacaggaaaggtgtatgtgggcctgaagccgggttcatctctgggcttgcacaatgcagaaatcgtagaagtacacggacctcatccggcaggtaacgtgggcgtgctgatcaatcatacgaagccaatcaatcggggcgaaacggtgtggacgctcaaggctaccgacctgatcgtgatcggacgtttcctgcttacgggcaaagccgattttaccagaatgattgccatgaccggctcagacgctgcagctcacggatacgtccgtattatgccgggttgcaatgtctttgcttccttccccggccgactgacaataaaggaatctcacgagcgtgtgatcgatggcaatgtgctgaccggtaagaagctctgcgagaaggagcctttcctgtcagcccggtgtgaccagatcacggtgatccccgaaggcgacgatgtggacgaactcttcgggtgggctgcaccccgtctcgatcagtacagcatgagcagagcttatttctcttggttgcaggggaaaaacaaagagtacgtactcgatgcccggatcaagggtggcgaacgtgctatgatcatgagcaacgagtatgaccgcgttttcccgatggacatctatccggagtatttgctcaaggctattatagcattcgacatcgacaagatggaggacttaggcatatatgaagtggctccggaggactttgccacttgcgaatttgtggatacatccaagatcgagctgcagcgtatcgttcgcgagggcttggatatgctctataaggaaatgaat

SEQ ID NO: 2 - DNA, 603 bp, Porphyromonas gingivalis
gaactaagcaagtgttacatggataaagtgagctatgctctgggattgagcatcggtaataatttcaagtcttcgggcatcgacagcgtcgttatggatgatttcatgcaaggtctgtctgatgtactggaagaaaaagcccctcagctctcgtatgacgaggccaagcgcgaaatagaggcgtatttcatggatttgcagcagaaggctgtcaaactgaacaaagaggccggagaagaattcctcaagataaatgcacacaaggaaggtgtgacgaccttaccgagcggcttgcaatacgaagtcattaagatgggagagggcccgaaacccaccctttcggacacggtaacctgtcattatcacggtacgctcatcaacggtatcgttttcgatagctctatggacaggggagaaccggccagtttccctctaagaggagttatagccggctggacggagattcttcaattaatgcctgtaggatccaagtggaaagtaactataccgagcgatctggcgtatggagatcgtggtgccggcgaacatatcaaaccgggtagtacgctcatttttataatcgaattattgagtatcaacaaa

SEQ ID NO: 3 - DNA, 837 bp, Porphyromonas gingivalis
caaaaaaacaaacgaaagatgaaaaaagcattacttattggtgctgctcttttgggagcagtcagttttgcaagtgctcagtctttgagcacaatcaaagtacagaacaattcagtacagcaacctcgtgaggaagccactattcaggtttgtggagaattggcagagcaagttgactgcattgggacaggtaattctgcaatcatagccgctgcagcgaaatttgaaagcgatgatctcgaaagctatgttggctgggagatcatgagtgttgatttcttccctggatataaagcgtgcaagtacacatctgcagtctgggctgatgatatgaccattttgggccaatcagaagatagtgatcccgaaatgcagactatcaacaatcttgctctcaagactagtgtcaagattgaagccggcaagaattacatagttggttatattgctaataccgcaggtggacatcctatcggatgtgatcagggccctgccgttgatggttatggagatttggtttctatatcagaagatggtggtgctactttccctccgttcgaatctcttcatcaagcagttcctaccttaaattacaacatctatgtcgttgttcatttgaagaagggtgaaggtgttgaggctgttcttaccaacgacaaggctaatgcttatgttcagaatggcgttatctatgtagccggagctaatggtcgtcaggtatctctgttcgacatgaacggtaaggttgtttataccggcgttagcgaaacgattgcagctcctcagaagggcatgtatatcctccgtgtaggtgctaagagcatcaagctggctatc

SEQ ID NO: 4 - DNA, 471 bp, Porphyromonas gingivalis
  modified_base (5)..(5): n is a, c, g, or t
cgtgnattcctgccggagaaagctctctatatcggctgccgcgtggagacgcaagaggggcatgccgtaggtttcggactggatgacggccctgcgatgaaaggcaagggcgatctggtcgggagctatcttcccggtgctgctccgatgccttttgtcccgctttctgatattccggctcgttcgatggatgccaatttttatatctattctcgtatttcactgggttcgggcacgcaggatgttctccagcataggatgaaagtgtatcccaaccctgccacgacggagctgcatgtggaagccctgtccgcatgggtgggcgagcaggctgcggtatatgatatgcgtggtcgtcgggtatcggctcggacggtggatagcgagaagctgtgcatcgacattgcctcactgcccgtgggcgtctatatgctgcgcatcggcagctactcggccaagttcgagaagaga

SEQ ID NO: 5 - DNA, 1686 bp, Porphyromonas gingivalis
acaagaaatgtttcactcataaaaatgccaagaattatgaaattaaaaattgcactcagactgctgctggcgacttttgccatagttttatttagccctctggccaaggcccagatggatattggtggagacgatgtattgatcgagacgatgtccaccctatcaggatattcagaggatttttattacaagatggctgtggcagacaatggatggatctatgtgatgttggatttctctcgtatttattttgatgatgtcaggctgtatcgttccaaagacggtggtgctacttaccaaaagttagggtctttggggtctttggtgccttatgacttcgatgtctcgcattgcgattttattgtaacgggaaaggatgaagatgatatcaatgtttggacagtcatgacagcattcgaatatgtaggtggtactattggcaatggcgttttgctgatgcatcgccatgatgcagatatcaataatacagagtgtgtgtacaagaaggatttccctaataatagactgatgggtgtagccatcgcctccaactaccgtgcgccctctccttacggtttggggggcgatccttttgctctcgctgtcgccgttagtggctccggaagcgatcacagcttcttggactatattttttcgttagatggtggagtacactttgagcaaaagcgtatttacacaagaccccaaaaactgactatcaatagagtagacctttcattaggcagtacatctccttctcttggatttaatacttggccactaatgggagtcgtattcgaaatgaataagaaccttgatggcttcgacattggtttcatttccaactttgtggactatgatccccgctatgcgtggtctgaaccgataataatagaagaagactgtggatggactgattttaatcctttgggagcactaagtatagagatccaaatgatgttggatgacaattcggataataccgtgggtggagaacgctcccataacttcctgatcacttacccgggccattacgtatatccgaagcaatctttcaattattctcccggacatacaccgacaaagaaagatctggtctttaaacactgtataggtattccggctttggcatacgataaggaaggcgatcgttatctgactacttttcaagatcacaatctaatgagatacagatggatcaaatacgatgacattaactctttttatggttggagttggccatatgtatatgcaaaagaagctaaagataaaaagaggcgccgtccgcaagtagcactcaatcctaccaatggaaaggcttgttgggtatggcatactcgcaagagcccatatgatgaaaccaaaccacatcctactcctgtaattattaaacatttcctatggtccgatacggagtgggtacatgctctggacgtgggggacgtattgcagaaggagggtagcatgaagctctaccccaatcctgccaaagaatatgttctgatcaacctacccaaagaaggggggcacgaggcagtcgtatacgacatgcagggccgaatcgtggagaaagtttcattttcagggaaagaatataagctgaatgtgcagtatctgtccaaaggtacgtacatgctgaaagttgtagcggatacggagtatttcgtggaaaaaatcattgtagag

SEQ ID NO: 6 - DNA, 1173 bp, Porphyromonas gingivalis
caaatgaaacgattactcccctttctccttttagcaggactcgtagccgtaggaaacgtgtctgctcagtcaccccgaatccctcaagtggatgtacacactcgcatcgcaagaaatgcccgttatcgactggacaagatcagtgtcccggattctcgtcagatattcgattacttctataaagaagaaacgatacccactaaaatacaaacgaccacaggaggtgcaattacaagcatcgattcgcttttctatgaagacgacaggttggttcaggtgcgctattttgacaataaccttgaattaaaacaagcggagaagtatgtatacgacggttctaagctggtccttcgagaaattcgcaagtcgccgacagacgaaacgccaataaagaaagttagctatcactatctctgtggcagcgatatgccttttgagattacgacagagatgagcgatggctattttgaaagccatacgcttaactatctgaatggaaagattgcccgaatagatatcatgactcaacagaacccatcggccgaattgatcgaaacgggtagaatggtatatgagtttgatgccaataatgatgctgtactgcttcgtgacagtgtatttcttcctcttcaaaacaagtgggtagaaatgtttactcaccgttatacatacgacaataagcataattgtattcgttgggaacaagacgaattcggcaccctcacccttgccaacaacttcgaatacgacaccactatccctctgtcgtctgtattgttccccacgcatgaggagttcttccgtcctcttcttcccaattttatgaagcatatgcgtacgaagcaaacgtatttcaataactccggagaaggcttgtcagaggtatgcgattacaactacttctataccgatatgcagggtaatgcactgaccgatgttgccgtgaacgaatcgatcaagatttatcctcgtcctgccacggattttctgcgtatagaaggttcgcaactgcttcgcctttcgctattcgacatgaacgggaagctcatcagagctaccgaattgacaggcgatttggccattatcggagttgcatctcttccgagaggcacttacatcgcagaaataactgctgcaaacagcaaaaccatacgtgcaaaagtatcgctcaga

SEQ ID NO: 7 - DNA, 1284 bp, Porphyromonas gingivalis
aagaggaatcccttacctttgacggcatcaaatcgaaagatttttataaaaatgagacagcatttatctctatttccttttatcttgtttctgcttcttgccttctcttatgtcggttgcagaacagtccgacaaacacctaagcagtcggaacggtacgtcgtagtcctgtctttggacggcttccgaccggactataccgatcgggcacgtacaccggcgttggatcggatggcacaggagggattgagcgggtcgctccaaccatgcttcccctcgcttacatttcccaatcattacagcatggctacggggctttaccccgatcatcacggtatcgtagccaatgagtttgtggattcgctactgggcatctttcgtatatccgaccgaaaagccgtggagacccccggattttggggcggcgagccggtttggaatacggccgcacgccaaggcatccgtaccggtgtctacttttgggtaggatccgaaacggctgtgaacggaaatcggccgtggcggtggaaaaaattctcctccaccgttccgtttcgtgaccgtgccgactccgtcatcgcgtggctcggactgcccgaaaaggagcgaccgcgcttgctcatgtggtacatcgaggagccggatatgatcggacacagccaaacgcccgaaagcccgctgacactggcaatggtagagcggttggacagtgtggtcggctatttccgcaagcggttggactctctgcccatagccgcacagaccgacttcatcatagtatccgatcacggtatggccacgtacgaaaatgagaaatgtgtcaatctgtcgcattatctgcctgcggacagtttcctctacatggccaccggggccttcacccacttgtacccgaagccctcctataccgagcgagcctatgagatcctgcgggccattccacatatatcggtttaccgcaagggggaggtgcccaagcgtttgcgctgtggcaccaatcctcgtttgggcgaactggtcgtgattccggacataggctccaccgtctttttcgcaataaatgaagacgttcgtccgggagcggcacatggctatgacaaccaagcaccggaaatgcgggctttactccgggctgtcggacccgatttccgtccgggcagtagggtggaaaacctgccgaatatcaccatctatccgctcatatgcaggctgttgggtatagagcctgcacccaacgatgcggacgaaacgttgctgaacggcctgatccgagacaaacgacca

SEQ ID NO: 8 - DNA, 846 bp, Porphyromonas gingivalis
ctttcccgtggagtttttcccctgatgtatggccgaagaggaagcattcgtgcctcttcagggcatagggacaaaatttttaagaatacaattatcagatttatcacaatgaaagtaggtttgttcatcccctgttatgtcaatgcagtgtatccggaagtgggtatcgccacgtacaaactgctgaagagtttggacatagatgtcgactacccgatggatcagacatgttgcggccagcctatggccaatgccggattcgaacagaaagctcaaaagctggctttgcgattcgaagagctgttcgagtcgtatgatgtagtcgtagggccatcggccagttgcgttgctttcgtgaaagaaaactatgatcatatcctcagaccgacaggacatgtctgcaagtcggcagccaaggttcgggatatatgcgagttcttgcacgatgacctgaagatcaccagcctcccctcccgattcgcccataaggtgagcctgcacaacagttgccacggtgtgcgcgaactgcatctgtccacccccagtgaagtgcaccgaccgtaccacaacaaggtgcgccggctattggagatggtgcagggcatagaggtattcgagccgaagcgaatagacgaatgctgcggtttcggcggtatgtactcggtggaggagccggaggtatccacctgtatggggcatgacaaggtgctggatcacatatccacaggtgcggagtacatcacagggccggacagctcgtgcctcatgcatatgcagggagtgatagacagagagaaattgccgatcaagacaattcatgcagtagaaattttagcagcaaactta

SEQ ID NO: 9 - DNA, 753 bp, Porphyromonas gingivalis
cctctgaaaaaacgaatggatattgtaagtatggccgataaagctcttgtagtggagatgagagatgtgacgctctgtcaggaggaaaacgtcatttttcaaaatttgaatctgaccctttccgccggagacttcgtctatctgataggctcagtgggatcggggaagagcactttgctgaaggctttgtatgctgaggtgcctatctctgccggttatgcccgcgtgatagattatgatctggcaaagttgaaacggaagcagttgccctatctgcgcaggaatttgggcattgtgtttcaggatttccagttgctgaacggacgtactgttgcggagaatttggatttcgttttgcgagctacggactggaaaaaccgagccgatcgcgagcagcgtatcgaggaggttttgacccgtgtgggaatgtctcggaaggcttataagagaccgcacgaactgtccggaggggagcaacaacgtgtgggtatagccagagctttgctggcgaagcctgcgttgatcctggccgacgaacccacaggcaacctcgattcggtgaccggattgcagatcgcttctctgctctacgaaatcagtaagcagggcactgcagtacttatgagcacgcacaacagcagcctgctgtcgcatctgccggcacggacattggccgttcgtaagaatggcgatgcctcctctttggtcgagctgagtgcagatgctgtttcaagaaaaaatacggaaatagat

SEQ ID NO: 10 - DNA, 714 bp, Porphyromonas gingivalis
accaggcattgtccggcttgtcgctcttcctttcacctcataaaaacaagtaaaacaatgattgaaatcagcaacctcaccaaggttttcagaacagaagaaatagagacggtagccctcgatggcgtatcgctcaaagtggacaaaggcgaatttatcgccataatggggccttcgggatgcggtaagtccactctgctcaatatcctcggccttctcgacaatcccacttccggtatctacaagctcgatggggcagaagtgggcaacctccgggaaaaagacaggactgccgtccgtaagggcaatatcggcttcgtattccagagcttcaacctcatcgaagagatgacggtaagcgagaacgtggagttgccgctcgtctatctgggtgtgaaggcctccgagcggaaagagcgagtggaggaggcactgcgcaagatgagcatcagccaccgggccggccacttccccaatcagctctccggaggacaacagcagcgcgtggctatcgcccgtgccgtggtggccaatccgaagctcatcctcgccgatgaacccacgggtaacctcgactccaaaaacggagccgatgtcatggaactgctcagaggtctcaatcgcgaaggtgcaaccatcgtcatggtgacgcactccgagcacgatgcacgtagtgccggccgcatcatcaatctgttcgacggtaagattcgc

SEQ ID NO: 11 - DNA, 1812 bp, Porphyromonas gingivalis
  modified_base (199)..(199): n is a, c, g, or t
agcacagaaacaaatagcaaatctgaaatgaaagaatttttcaaaatgtttttcgcctcgatcctcggggttataacggcaggaatcatcttgttctgtatctttctatttatctttttcggcatcgtagccggtattgcctccaaggcaacgggaggaaccattccgaagatcgaagcaaactccatcctacatatanacaattcttctttccctgagatcgtatcggccaatccctggagcatgctcacaggcaaagacgagtccgtatcgctctcacaggcagtcgaagccatcggccaagccaaaaataatcccaacataaccggtatcttcctcgatctggacaacctttccgtcggtatggcatcggcagaggaattgcgtcgcgcgttgcaggatttcaagatgtcgggcaagttcgtcgtatcctatgccgacagatacacccaaaagggttactacctctccagtattgcagacaaactctacctcaatccgaaaggaatgttggggcttatcgggattgcgacccaaacaatgttctacaaagatgccctcgacaaattcggcgtgaagatggagatcttcaaggtaggcacctacaaggcagccgtagagccattcatgctcaacaggatgagcgatgccaatcgcgaacaaatcaccacatacataaacgggctttgggacaagatcacatccgatattgcagagtcgcgcaagacggcaatggattccgtgaaaatgtttgccgacaaaggcgaaatgttcggtcttgccgagaaagcggtggagatgaagctcgtggatgagctggcttaccgtaccgatgtggagaaagaactcaaaaagatgtcccaacgcggagagaaagatgaacttcggttcgtatcgctttctcaggttctggccaatggcccgatgaacaaaacgaaaggcagtcggatcgccgttctctttgccgaaggtgaaataacggaagaaataataaagaagccgttcgacactgacggtagctccatcacacaagaactcgccaaagaaatcaaggcagcagccgatgacgatgatatcaaagccgtagtacttcgtgtcaattctccgggaggtagtgctttcacttccgaacagatatggaagcaggtagccgatctcaaggccaaaaagcctatcgtggtctccatgggcgacgtagcagcctcgggcggatactacatagcctgcgcagccaacagtatcgtggcagagcatacgactctgaccggctccatcggcatattcggcatgttcccgaacttcgcgggcgtagccaagaagataggagtgaatatggacgtcgtacagacatccaagtatgcagacttgggcaacaccttcgctccgatgacggtcgaagatcgtgccctcatccaacgctacatagagcagggctacgacctcttcctcactcgcgtatcggaaggccgcaaccgcaccaaggcacagatcgacagcatcgctcaaggccgtgtatggctcggcgacaaagctcttgcactcggtttggtggatgagcttggaggtttggacacagctatcaaacgggccgcgaagctggctcagctcggtggcaactacagcatagagtatggcaagaccaagcgcaacttcttcgaagagttgctctcctcatcagcagcggatatgaagtctgccatcctgagtaccattctctccgatccggaaatagaagttctgcgcgaactccgctccatgccgccccgtccttcgggcatacaggcacgtctcccctattacttcatgccgtac

SEQ ID NO: 12 - DNA, 972 bp, Porphyromonas gingivalis
ctaacgttgttttgttgcaactatttcaaacagatgagagcaaacatttggcagatactttccgtttcggttctctttttcttcgggacagcgatcggacaggctcagagtcgaaaccgtacatacgaggcttatgtgaaacagtacgccgacgaagctatccgacagatgagccgctacaatataccggcaagcatcaccatagcacaggctttggtggagacaggagccggagccagtacactggccagcgtacacaacaatcacttcgggatcaaatgccacaaatcgtggacgggcaagcgcacctatcgtaccgacgatgcgccgaacgaatgcttccgcagctattcggccgctcgcgaatcgtatgaagatcattcccgatttctgctccaaccacgctatcgtcccctgttcaaactcgacagagaagactatcggggctgggctacggggttgcaacgctgtggctatgccaccaatcggggctatgccaatctgctgatcaagatggtggagctgtatgagctatatgctttggatcgcgagaagtacccctcatggttccacaagtcttaccccgggtccaacaaaaaatcccatcaaacgaccaagcagaagcagagcggactcaagcacgaagcttacttcagctacggactgctctacatcatagccaagcaaggcgataccttcgattctttggccgaagagttcgacatgagagcctccaaactggccaaatacaacgatgctcccgtggatttcccgatcgaaaagggcgatgtgatctatctggagaaaaagcacgcatgctccatctccaaacacacacagcacgtagtgcgtgtgggcgattcgatgcacagtatctcccaacgctatggcatccggatgaagaacctctacaagctcaacgacaaggatggcgaatatataccccaagagggcgatatactgcgcttgcgc

SEQ ID NO: 13 - DNA, 1599 bp, Porphyromonas gingivalis
aggatccccgacgagcagaccggacgtatcatggacggacgtcgatattcggatggcctccatcaggctatcgaagccaaagagcatgtgaaagtagaggctgcgacacagacatttgcaactatcactttgcagaactatttccgcatgtatcataagctggcagggatgaccggtactgctgaaactgaagcgggagagctttgggacatctacaaactggacgttgtagttattccgacaaacaagcctatcgcccgtaaggatatgaatgatcgtatctataagacggcacgtgaaaaatatgcagcagttatcgaagagattgtacgtcttgtcgaagagggcagacctgtacttgtcggtactacttcggtggaaatatccgaattgttgagccgtatgttacgcttgcgtggcatccaacacaatgtactcaatgccaaattgcatcagaaggaggccgagattgtagctcaggccggtcagaaaggaactgttaccatcgcaacgaacatggccggtcgtggtaccgacatcaagctctctgccgaggttaagaaagccgggggtttggctatcattggtacggaaaggcacgaatccagacgagtggacagacagcttcgtggtcgttccggccgtcagggtgatcccggttcgtccatattctatgtttcccttgaagatcatctgatgcgcctctttgccacagaaaagattgcatcattgatggatcgtttaggtttcaaggaaggagaagtgctcgaaaacaacatgctgagtaagtccgtggagcgtgctcaaaagaaggtggaagagaacaacttcggtatccgtaaacatctgcttgagtacgatgatgtaatgaattcgcagcgtgaagtcatttatacccgtcgccgtcatgctttgatgggagagcgtatcggtatggatgtactcaataccatatacgacgtatgtaaggctctgattgacaattatgcagaagccaatgatttcgaaggcttcaaggaagatctgatgcgtgcactcgcgatagaatctcctatcacgcaagaaatattcagaggtaagaaagcagaagagctgaccgatatgcttttcgatgaagcttacaagtctttccaacgtaagatggatctgatcgcagaagtggcccaccctgtggttcatcaggtattcgagacccaagccgccgtgtacgagcgcattctaatccccattacggatggtaaacgtgtctataacataggatgcaatttgcgtgaagcggatgaaactcaagggaaaagcatcatcaaagaatttgagaaagctatcgtactgcatactatcgatgagtcttggaaagaacatctgcgtgagatggacgagcttcgtaattccgttcagaatgccagctacgaaaacaaagatccactacttatctataaactcgaatcttacgaactgttccgcaagatggtagaagccatgaaccgtaagaccgtagcgatcctaatgcgtgctcggataccggtaccggaggctccttcccaagaagagctggaacacaggcggcaaatagaaatccgacatgcaacccaacaacgt

SEQ ID NO: 14 - DNA, 2160 bp, Porphyromonas gingivalis
aaatcttgccgtgttattggccagacgaggcgatacggatgctgccctgtcggactacgaccgtgccatcaaagcctatccggagtttgccgatgcctatttcaatcgcggcctgctgttgctttcgcgcggaaaggccaaagaaggcatcgccgatctgagtcgggcaggcgaatacgggctctacaaggcgtacaacatcatcaaacgaatgagcacgaagtcatgatctccgtcaataacctgactgtcgatttcggcacccgtctgctcttcgatcaggtatcattcgtcatcaacaggcgcgaccgtatcgctcttgtagggaagaacggtgccggcaagagtacgctgctcaagctgattgccggcatggaagaaccgacatccggacacatagcacgccccaaggggatccgcataggctatctgccgcaggtgatgcgtttgcaggacggacacacggtttacgaagaggtcgagcaggctttcaacgatattcgccaaatagaggaagagatacggcgtctgtccgatgaaatggccggacgtacggactacgaatcggatgactatatccgactgatagagcattatacgaatatgagcgagaccctctctctcatgcagcagggcaactatcatgctgcgatcgaacagacattgatcggtctgggcttcggccgagaggacttccaccgccccacagccgatttcagcggaggatggcgtatgcggatagagctggccaaacttctgctccaacgccccgaagttttgctgctcgacgagccgaccaatcacctcgacatcgaatccatcggctggctggagcagttcatcgccaccaatgcaggagccgttatcctggtgtcgcacgacagggcattcatcgacaataccacgacacgcactatcgaaatagaactgggacatatatacgactacaagaccaactacagccactatgtggagctgcgcgaagagcggctgcgacagcagatgcgtgcctacgagaatcagcagaagatgatccgcgatacggaggacttcatcgaacgattcagatacaaggccacgaagtccgtacaggtacagagccggatcaaacagttggagaaagtagagcgcgtggagatagacgagcgggatcgttcggcatttcacttccgctttatcccggcacagccttccggcagttatccgctaatagtggatgatttggccaaggcttatggcgatcaccaggtgttttccggagctacatacaccatcgaaagaggcgaaaaggtggctttcgtaggcaaaaacggtgccggcaaaagtaccatggtcaagtgtatcatgggagagctgacagactacaccggcaagctcgaactggggcacaacgtgcagctgggctactttgcccaaaacgaagcccaagagctaagaggggatctcacggtattcgacacgatagaccgtgaggccgtgggcgacatccgtctgcgcctgaacgatttgctcggggcttttctcttcgggggcgaagcatcggaaaagaaagtaagtgtcctgagtggaggagaacgagcacgattggctattatcaggcttttgctacagccggctaacttccttattctcgatgagccgaccaatcacctcgatatgcgctcgaaggatgtactgaaagaggcgatcaagaacttcgatgggactgtcatcgtagtatctcacgaccgtgagttcctcgatgggcttgtcagcaaggtgtatgaatttgcagatggacaggtgaacgaacacctcggaggtatatacgactatctccggacccgccgtatgcagacgctgacagagctggagcgaaccactacgatcgaaacaaaaaccacacgggaggctatacctgaaacggaagccaaagcggactaccgtcggcaaaaggaggtagccaaacagctgcgcacgttggagcgaaccgtagcaacctgcgaggagcggatcggaaaattggagtcggaattacaggcaatagagatgctactgcaagatccgaaacatgcgactgacgcgaatctgttcgagcgatacgccggcatgaaacaagaactcgaaaaggccatggaggactgggaacaggcttccgaagctttatccgaagcccaagga

SEQ ID NO: 15 - DNA, 1158 bp, Porphyromonas gingivalis
tatttgaagctattaatactacaaatagccttgatgaatttcttaaaaaaagaaccgtttaaaatattctctatgatttatctgctgttagatacaataacaaaccgtgccggtacagaacgcgccgtgatcaacttggctaacaacctgcatgccaatggtcatcgcgtatcattagtcagcgtttgtacaaaagaaggagagccttccttccaagtagaaaaaggaatagaagtacaccatctcggaattaggctttatggcaatgcattagcccgcaaaacagtatatttcaaggcttatcgaaggataaaagccctatacaagaagcgtgaaccggttttattgatagggactaatatttttatcaatacaattttgtctcagatcagtaacagaggcagaatatttacgatcggatgcgaacatatctcttatgatattgcccgccctattacaaaacgcataagggggtttctgtattcagggcttgatgccgttgtagcactgacaaaaagagatcagcaatcgttcgaggcaatcttacgtggacgctctaaagcatatgtcatacccaatcaagtttcatttactacagtccaaagagatgctactactcacaaacaaatgttggcgattggcaggcttacctaccagaagggttttgaattcatgatagaagatgcatcacgagtgctgcgagaaaggcctgattggaagcttatcatagtcggagatggcgaaaatgaatcgatgctacgtaaagaaattgcatctcgcaatatggagtcgcaaatagaaatacatccatctacaccggaaattcgcaaatactacgaatcatctgctatttatctaatgacgtcccgtttcgaaggactaccaatggtacttctcgaagcagaagcatatgcactacctataatctcatacgattgtccgaccggcccgagggaactgatcgaaaacggtcgcaatggtttccttgtgccaatggaagcacatgaagacttcgcggataagttacgcttattgatggatgatgaaactcttcgtaagaaaatgggacaagaatcagagttgatggtcaaatcctactctccggcaaatatctatgaatgttggaagaaactattcgtcgaaatcggctacatgaat

SEQ ID NO: 16 - DNA, 1965 bp, Porphyromonas gingivalis
acaacgaaagaaaacgagacaacaacaaaaaacgaatatagaattatgggaaaaatcattggaattgacttaggcacaacgaactcttgtgtctctgtattggaaggtaacgaacctatcgttattacaaacagtgagggcaagcgcacaacgccctcggtagtggcttttgtggatggtggcgagcgtaaggtgggcgatccggccaagcgtcaggccatcaccaatccgaccaagacgatatactctatcaaacgcttcatgggcgaaacttacgatcaggtttccagagaagtggagagagtgccattcaaggtagtacgtggggacaataatactccgcgcgtagatatagacggtcgtctctatacgccgcaggaaatttcggccatgatccttcagaagatgaagaagacggccgaagactacctcggtcaggaagtaacggaggccgtgatcactgtgcccgcatacttcaacgacgctcaacgtcaggcaacgaaagaagcaggagagatcgccggcctgaaagttcgccgtattgtgaacgagcctacggcagcttctctggcctacggtctggacaagtccaataaggatatgaagatcgctgtcttcgacttgggtggcggtaccttcgatatctctatcttggaattgggcgacggcgttttcgaagtgaaatcgaccaacggtgatacgcacctcggaggagacgacttcgaccacgtgatcattgactggctggcagaagagttcaagtctcaggaaggtgtggatcttcgccaggatcctatggctatgcagcgtctgaaagaagctgccgaaaaagccaagatagagctctccagcacttcatctacggagatcaacctcccctatatcatgccggtgaacggcatccccaagcacttggtgatgacgcttacaagggctaagttcgagcagttggccgatcgtctgattcaggcatgtgtggcaccctgcgaaacggccttgaaagatgccggtatgtcacgtggcgatatcgatgaagtgattctcgtaggtggttccacacgtattcctgctattcaggagattgtggagaagatcttcggtaaggctccgtccaagggtgtgaatcccgacgaagtggtagctgtgggtgccgctattcaaggcggtgttctgaccggtgaggtaaaggatgtcttgctgttggacgttacccccttgtcgctcggtatcgagactatgggaggcgtgatgactcgcttgatcgatgccaataccactatcccgacgaagaagagcgaaatctttaccacagcagtggacaatcaaccttcggtagagattcatgtacttcagggtgagcgttctttggctaaggacaataagagcatcggccgtttcaacttggacggtattgctccggcgccccgtcagacaccgcagatcgaagtaacgtttgacatcgatgccaacggtatcctgaatgtaacggctcatgacaaagctaccggcaagaagcagaatatccgcatcgaagcctccagcggtttgtccgatgatgagatcaagcgcatgaaggaagaggcgcaggccaatgccgaagcagataagaaagagaaagaacgtatcgacaagatcaatcaggccgacagcatgatcttccagacggaaaagcagttgaaggagttgggagacaaattcccggccgacaagaaggctccgatcgataccgctctcgacaaactgaaagaagcacacaaagcacaggatgtagctgctatcgatacagccatggccgaactgcaaaccgctctttccgcagcgggcgaagagctttacaagaatgccggagcagcccaaggtggcgcacaacccggtccggacttcggcggtgctcaaggtccctctgccggtgatcagccctctgacgacaagaacgtcacagacgtagacttcgaggaagtgaag

SEQ ID NO: 17 - DNA, 1401 bp, Porphyromonas gingivalis
aagtgggcacgtacaactactttaaggatatcgaacgcaacaatctataaaactatgcgctacgacttagctatcatcggtggagggccggccggttatacggctgccgaacgtgctgccaaaggtggcctgaaaaccctcctaattgagaagaatgctctcggtggtgtatgcctcaacgaaggatgtataccgaccaagacgctactctactcggccaaagtgctacatcaaattgctacggcatctaaatatgcagtaagtggaacggccgatggacttgacctcggcaaggtgattgccagaaaaggtaaaatcattcgcaagctgactgcaggcatccgttcacgcctgacagaggccggagtagagatggtgacggcagaagctaccgtaacgggatgcgatgcagacggcatcatcggcattactgcgggcgaagcacagtacaaagctgccaacctgctactatgtaccggttcggagacgtttattccacccatccccggagtggagcagacagagtattggacaaaccgtgaagctctacagaacaaagagattccgacctctctcgtcatcatcggtggtggagtgatcggaatggagttcgcttctttcttcaacggtatcggtacgcaagtgcacgtggtggagatgctgccggaaatactcaacggtatcgatcccgaacatgcagctatgctacgcgctcactatgaaaaagaaggaatcaaattctacctcgggcacaaagtaacatcggttcgcaacggagctgttacggtagaatacgaaggagaaagcaaagagatcgaaggagaacgtatcctgatgagtgtgggacgtcgccccgtgctgcaaggattcgagtcgctcggattggtgcttgccggcaaaggtgtaaagactaatgagaggatgcaaacttccctgcccaatgtctatgctgcaggtgatattacaggcttctcgcttttggcacatacggctgtacgggaagcagaggtagcagtagatcagattttgggcaaaacagacgaaacgatgagctaccgtgccgtaccaggtgtggtgtacaccaatcccgaggtcgccggtgtgggagagacggaagaatcgcttcgcaaagcaggacgtgcctacactgttcgtcgccttcctatggccttctccggtcgatttgtagcagaaaacgaacaaggcaatggagagtgcaaactactacttgatgaagagaaccgcttgatcggagcacacctcattggcaatccggccggcgaactcatcgtaaccgctgccatggccatcgagaccggcatgacggatcgacaaatcgaacgaatcatattccctcatccgactgtaggcgaaatcctaaaagaaactctcgccggaggt

SEQ ID NO: 18 - DNA, 2835 bp, Porphyromonas gingivalis
cctaagatacttatggaattgaaaagatttttatcacttggtcttctgcttgtgggattcattccgatgaagctttctgcccaacaggctcagccactccctacagatccggctgttcgtgtcggtaagttggacaacggattgacttatttcatccgtcacaacgagaacccgaaagatcgtgcggatttctttatcgcacaaaaggtaggttctattcttgaagaagatagccagtccggtttggctcacttcttggaacacatggctttcaacggtacgaagaacttccccggtaagaacttgatcaactatctcgaaacgatcggtgtacgtttcggtcagaacctgaacgcttctaccggattcgacaagacggaatatacgataatggatgtgccgactacacgtcagggaatcatcgactcctgcttgcttatcctgcatgattggagtaacaatattaccctcgacgggcatgagatcgacgaggagcgcggtgtgatccaggaagagtggcgtgctcgtcgcgatgccaaccttcgtatgttcgaggctatacttgccaaggctatgccgggtaataaatatgcagaacgcatgcccatcggtctgatggacgtcgtgctcaacttcaagcatgatgagctgcgcaactattataagaaatggtatcgtcccgacctgcaaggtctggtgatcgtgggagatatcgatgtggactatgtggagaacaagatcaaagaactcttcaaggacgttcctgctcccgtgaatccagcagagcgtatctatacgccggtagaggacaacgatgagcctatcgtagccattgctaccgatgctgaggctactaccacgcagctctccatcagcttcaagagcgaccccactcctcaagaagtgcgaggatcgatattcggacttgtggaagactatatgaaacaggtgatcactacagccgtgaatgagcgtctgtccgagattactcacaagcctaacgctcctttcctcagtgcaggagctttcttctctaacttcatgtacatcacccagactaaggacgcattcaattttgttgccacggttcgtgagggtgaagcggagaaagcgatgaacgcattggtggcagagatagaaagcctccgtcagttcggtatcaccaaaggcgaatacgatcgtgcacgcacgaatgtgctcaagcgatacgagaatcaatacaacgaaagagacaagcgtaagaacaatgcttatgccaatgaatactccacctacttcaccgatggcggctatatcccgggtattgaggtggaatatcagacggtgaatgcttttgctcctcaggttcctctggaagcattcaatcaggctattgcccaaatgatcgatccggtgaagaatgctgtcgttaccctcaccggtccttcaaaggctgaagccaagattccgagcgaagcagacttcctcgctgctttcaaagctgctcgtcagcagaaagtagaagccaagaaagacgaagtctccgaccaaaaattgatggagaaagctcctaaggccggaaagatcgtttccgagaagaaagatcagaagttcggtaccacggaacttacccttagcaatggcatcaaagtatacctcaagaagaccgatttcaaatcaaacgaaatcctgatgagtgctctcagcccgggtggtatcctctccggaaagcatgctcccaaccaatctgtgatgaattcgttcatgaacgtgggtggcttgggcaacttcgatgctatccagctggataaggtgctgacaggtcgctctgcttccgtatctccctctttgtctctgctcagtgaaggtctttcgggcaaaacgactgtagaagatatggaaactttcttccagttgatctatctccaaatgactgctaaccgcaaggatcccgaagcgttcaaggccacacaggaaaagttgtacaataacttgaaaaatcaggaagccaacccgatggctgcgcttatggactctatccgtcataccatgtacggcgataatccgatgatgaaacccatgaaagctgctgacgtggagaaagtaaattacgatcaggtaatggctttctacaatgagcgattcgctgatgccggcgactttatgttcttctttatcggtaatctggatgaagccaagatgaagccattgatcgaaacttatcttgcttcattgcccaacctcaagcgtggcgataagatgaataaggctcaggtaccggctgcccgttcgggaaagatcgattgcaagttcgagaaggaaatggatactccttcgactactatattcgatgtcgtgtccggaaatgtggaatatacgctcaagaacagtctcctgctggaagtcttctcagccgtaatggatcaggtgtacacggctaccgttcgcgagaaggaaggcggtgcatacagtgtggctgcattcggcggtctcgagcaatatcctcagcccaaggctctgatgcagatctatttccccacggatcctgctcgtgccgaggaaatgaatgctatcgtttttgctgagttggagaagcttgccaaggagggccccaatgtggaatactttaagaagactatcgaaaacctgaataagcagcacaaagaaagtctgcgtgagaatcgtttctggctcgaagccatgaaggcgtctttcttcgaaggaaatgacttcatcacagactacgaatccgtactgaacggtcttactcctgctgaattgcaaaagtttgcggcagacctcttgaagcagcagaatcgggttgttgtcatgatggctcctgttgcaaaggctcaa

SEQ ID NO: 19 - DNA, 2058 bp, Porphyromonas gingivalis
tacactatgagtaagaaaggaacaatcggggtaacgagcgacaatatattccccgtcatcaaaaaattcctgtacagcgaccatgagatattcctgcgtgagatcgtctccaatgccgtggatgctacgcagaagctgaaaacgcttacatccgtcggcgaattcaaaggcgagacgggtgacctccgcgtaacggtcagcgtggatgaagtggcacgcacgatcacggtcagcgaccgcggcgtagggatgaccgaagaggaggtggagaagtacatcaatcagattgctttctccagtgcggaagagtttcttgaaaagtacaaagacgacaaggccgccattatcggccacttcggactcggattttactcggctttcatggtgtccgagcgagtggacgtgatcacgcgctctttccgagaagatgctacggcggtgaaatggagctgcgacggatcgcccgaatacacgctcgaacctgcggacaaggctgaccgtggcaccgacatcgtgatgcacatcgatgaggagaatagcgagttcctcaaaaaagaaaagatagaggggctcctcggcaaatactgtaagttccttaccgtgccgatcattttcggcaagaagcaggaatggaaagacggcaagatgcaagatacggacgaggacaatcagatcaacgacacacatcctgcctggaccaaaaagcctgccgacctcaaggacgaagactataaggaattttaccgttcgctctatcccatgtccgaagagcctctcttctggatccacctcaatgtggactatccgttcaatctgacaggtatcctctatttcccgaagatcaaaaacaacttggatctgcagcgcaacaagattcagctctactgcaatcaggtttacgtcaccgatgaagtacagggtatcgtgccggacttcctcaccctcctgcacggggtcatcgattcgccggatattcccctcaacgtatcgcgctcctatctgcagagcgatgccaatgtgaagaagatctcgtctcatatcaccaagaaggtggcagaccgtctggaagaaattttcaaaaacgaccgccccacattcgaggagaaatgggatagtctgaagctcttcgtcgaatacggtatgctgacggatgagaagttctatgagcgtgcagccaaattcttccttttcaccgatatggacggacacaagtacacgttcgacgaataccgaacgctcgtcgaaggtgtacagacggataaggacggacaggtagtgtatctctatgctacggacaagcatggacagtacagccacgtgaaacgtgcatccgacaaaggctacagcgtgatgctgttggatggtcagttggatccgcatatcgtgagcctgctggagcaaaagttggagaagacacactttgtccgtgtcgatagcgatacgatcaacaatctgatccgcaaggaggaaagagccgaagtgaaactgtccgatacggagcgcgccactctcgtgaagctgttcgaagcacgcctgccacgggacgagaagaagcacttcaatgtagctttcgaatcgctcggagccgaaggtgaagccatccttatcacacaagccgaattcatgcgccgtatgcgcgatatggcacagctgcagccgggaatgagcttctacggcgaactccccgattcgtacaatctggtacttaataccgatcatccgctcatcgacagggtactctccggtgagaaagaatcggtagagccttcgctcacagagcttagagcgaaaatcgccgagctgaaagcggaagaggccaagctgctcgatgaggaaaaagggaagaaaccggaggaaatccctgttgccacgaaggaagccaaggagaacaacgccgtcgaacaggccaaaaccgaaggcagtatcaacgatcaactgaccaaatatgctcaggacaacgagctgataggtcagctcatcgacttggctctgctcggaagcggattgctgacgggagaggctttggccgaattcattcgtcgcagccagcgtcttctc

SEQ ID NO: 20 - DNA, 1446 bp, Porphyromonas gingivalis
gacattcgacagaaaagaccgtgcttcaacgccaatttgtacttttaccgtgcaatggaaaaactgatcgatattttggtcgtagacgatgatgtggcagtctgtgccgcactgcgtctggtgctcaagcgagcgggctataatcccgttatagccaacagtcccgacgaagctttgtccataatgcggaatcctgatggcggctgtaagccggctgtgattctgatggatatgaatttctccctttcgacctccggcagggaaggattggaactactggagaagatgcagatattcacttcctgccctgtcatactgatgacggcttgggcttcgattccactggcagtggagggaatgaggcttggagctttcgacttcataggcaagccatgggacaacgatcggctccttcgtaccatagatacggccttgcatctggctgctccctcagctgtggcgaatccatcggaacagtctgacagagatacagcccgtcagccgaaagctacagtccaagagaatgacccctgtgcccatatcataggccggagcgatgccatctgtaagatcaaggaacggatacgccgcatagctcccacccatgcctctgtgctgatcacgggcgagagcggtacgggcaaagagttgatagccgaagctctgcaccgtgggagcaaacgagcctcagccccattcgtcaaggtcaatttgggtgggattcccgaaagtttgttcgaaagtgagctgttcggacataagaaaggagcttttaccaatgctttttccgacaggaaaggacggttcgagctggctgatggcggcacgatctttctggacgaaataggcgaactaccggtcggcaaccaagtaaaactgctgcgagtgctacaggaacagacattcgagccgttgggcgagagcgtctcccaccgagtggacatccgtgtggtatcggctacgaatgcttccttggagcgaatggtagccgaaggacgtttcagagaggacctctactatcgaatcaacctgatacatctgcatctgcctccgctgcgtgagcgtcaggaggatatacagctgctggtggaagccttcagtgaagcctttgcccaatcgaacggattgccccatgccgtttggagtgcggaagctatgcgacgtatctgtgccatgcccctaccgggcaatgtacgcgaactgaaaaacgtagtggagcgtacgctattgctctcgggatcgagagaaatcagtgcccgggatgtggctgacttcggttcgcaggtgacggcagcagaccactccgacgaacgggctttgaccgacatggaggaagctgctatccgagagacgctgactaaatacaacggcaacgttagtcgtgctgcacgagccttgggattgagccgggcagctctttaccggcgaatggagaaatacggactg

SEQ ID NO: 21 - DNA, 789 bp, Porphyromonas gingivalis
agatctctgcaatcatttcaaaataaaaaacactcaagtatgcttaagataaagaacctccacgccacagtacagggcaaagagatattgaaaggaatcaatctggagatcaatgccggagagattcatgctatcatggggccgaacggatcggggaaaagtacgctctcttccgttttggtgggacatccctcctttgaagtcacggaaggagaggtgacattcaatggaatcgacctgctcgaactcgaaccggaagaacgtgcacacctcggactctttctcagtttccaatatccggtcgagatcccgggcgtcagcatggtgaatttcatgagggcagctgtcaatgaacataggaaagcgatcggagcagaacccgtatcggcaagcgacttcctcaagatgatgcgagagaagcgtgccattgtggagctggacaacaaattggccagccgttctgtgaacgaaggcttctccggtggagaaaaaaagaggaacgaaatcttccaaatggctatgctcgaacccaagctggctattttggacgaaaccgatagcgggctcgatatcgacgctctccgcatcgtagcaggcggggtaaaccgactccgctctccggagaatgctgctattgtgatcacacactatcagcgtttgctcgagtacatcaagccggacttcgtacacgtcctttacaaggggcgcatcgtcaagtcgggaggagccgagctggctctcacgctcgaagaaaaaggctacgactggatcaaggaagagataggagaa

SEQ ID NO: 22 - DNA, 1386 bp, Porphyromonas gingivalis
agcatggctaaggagaaaacgatctacgtctgccgttcgtgcggaaccaaatacgccaaatggcaaggcaactgcaatgcctgtggagagtggaactgcattgatgaggagaaggtgccggcaccggcatcgggcaagcatgcagccaagagttttatgcctcgggagcaggacaaccggccaagactcttacaggatgtggagtccggcgatgaagagcgtattcgcctcggcgatgaagagttcgaccgcgtactgggtggaggaattgtcaaaggagcatttgtcctgcttggcggcgagccgggaatcggtaagtccacgcttatcctccagacggtgctgcgtctgccgcagttgcgcacgctctatgtgtcgggcgaagaaagtgcccgacaactgaagatgcgcgccgaacgactggggcaagccatgaatgggtgctacgtatactgcgaaacgaatatagagaggatactctcccgtgcagaagaactcacacccgatctcctcgtgatagactctatacagacggtctataccgaggaaatggaaagctcggccggcagcgtggggcagatccgcgaatgtgccgccttactgctcaaatactgcaagactacgggtatccccgtcatcgtcatcggacacatcaccaaagaaggtagcatagccggaccgaaggtgctggagcatatagtggatacggtgcttctcttcgacggggataagcatcatctctaccggatactccgaggacagaagaaccgctatggcagtacttccgagctggggatatacgagatgcggcaggacggtctgcgtggcgtggagaatccgagcgaacatctcatcacacgcaatagggaagacctcagtggcatagccatagccgtagcgatggagggcattcgcccgatactcatcgaagcgcaggctttggtcagctcggccatttatgccaatccgcagcgttcggccacgggcttcgatattcggcggatgaacatgctcttagccgtactggagaaacgtgccggcttcaagctcatacagaaggatgtgtttctgaacattgccggaggtatcaaaatagccgatccggctacggatctggccgttatctcggcagtgctggcgtcgagtctggacatcgttatcccgccggccgtatgcatgacgggcgaggtcggactctccggagagatacgtcccgtgagccgcatcgagcagcgcataacggaagcgcgtcgcatagggttcaaagagatattggtaccggccgataatttccggcaggaggatgccggccgcttcggtattcggctcgtgccggtcagaaaggtggaggaagccttccgccatctgttctcgaaaggaagagaa

SEQ ID NO: 23 - DNA, 1119 bp, Porphyromonas gingivalis
gggtcttgtggaagtagcccagcaattggccgatcagggtgttcgcgttgtgatcgccggattggacatggactttcgacgtcagcctttcggacctatgccgggcttgtgtgccatagccgactccgtgaccaaagttcatgccgtgtgtgtggaatgcggccgattggccagctattctttccgtcgtgtccaaggcgatcagcaagtgatgctgggcgaactgaacgaatacagtcccctctgcagaacctgctacaggaaatgcagttctcccccacaaacagaagaaatccattcgacaatatgaatagcagacatctgacaatcacaatcattgccggcctctccctctttgtactgacattgggcggctgctccgtagcccaacaagatacgcagtggactctcggcggaaagctctttacttcggcgtggatacaacgttcggccgaatatcaagcgctttgcattcaggcatacaacatcgctacggaaagagtggacgctctaccggcagaacgtaaacaaggagataggccttatgccatcgtaacggacatagacgaaaccattttggacaatacgcctaactccgtgtatcaggctctcaggggcaaggattatgatgaagagacttgggggaaatggtgtgcacaggccgatgccgacacactggcaggagctttgtctttcttcctccatgcagcgaacaaggggatcgaggtcttttacgtcaccaaccgcagagacaatctgcgcgaagcaactcttcagaaccttcagcgttacggattcccctttgccgatgaagaacatttgcttacgacccatgggccatccgacaaagaaccccgtcggctcaaaatacaagaacagtatgaaatagtattgctcataggagacaacttgggcgacttccaccacttcttcaatacgaaagaagagtccggacgcaaacaggctctgggcctgacagccggggagtttggccggcacttcatcatgctgcccaatcccaactacggatcttgggaaccggcatggtacggcgggaagtatccgccactgcccgaaagagacaaagcacttaaacaactgcactcacagaacagcaga

SEQ ID NO: 24 - DNA, 1278 bp, Porphyromonas gingivalis
cgttggggtttttctaattttgtggccatgagcaccaatatagatgtacaacagatcaaacagcgtttcggcatcatcggtagcagtccgctgatggaacatgccatacgagtggcagcacaggtggctcctaccgacatgtccgtcctcgtgacgggggagagcggttcggggaaagagttcttcccacagataatccactactacagcgcccggaaacatcatagctacattgcagtcaattgcggagccatccccgaaggaaccatcgattccgagctgttcggacaccgcaaaggttcctttaccggagccgtatcggatcgcaaggggtacttcgaagaagcatccggcggcacgatctttctggacgaagtgggcgaactgcctttgcccacgcaggcgaggctgctgagggtgctggagacgggcgagttcatccccgtaggagccagccagtcgcagaagacggatgtccgtatcgtagcggcgacgaatgtgaacctcaaggaggcggtagcgaacgggaagttccgggaagacctcttcttccggctcaatacggtaccgatcgaggtgcctgcgctgcgtatgcgaccggacgacgtgcccttgctttttcgccgattcgccgccgacagcgccgagaagtatcggatgcctccgctgcgcctatcggacgaagcccgtaccatattaatgcgttaccgctggcccggcaatgtgcgagagctgcgcaatataaccgacaggctgagcatcctggaggaggagcggacggtatcggcagagaccatcactcgctacctggacgctgaggggatgcaagacctccaccccgtcgtgatccgacggaacgaaacgaccgaagcggacaaacaaatcccccattacgagcgcgaaatcatctaccaggtgctatacgatatgaagaaagagatagccgatttgaaggggatgatgaaccgcctggcgcaccacgaacagccctcatggcctgtagggtcggacgtctggggcaacgacgacaagcgcaccgcagatccgaagtggggcgtcagcacgcacaaggcccccatcgcgaacgcggcagaacccgtggagccgatacaggaagccagcgaatacaccgaggatccggtttcgctggaggaggtagagaagaaaatgatttcccttgcattggaacgccacggcggaaggcgcaagcagacagccgaggaactgaagatttcggagcggacactataccgtaaaatcaaggagtatggactggaa

SEQ ID NO: 25 - DNA, 1959 bp, Porphyromonas gingivalis
aaaaatcttccgaggtacgctccggcatttggcagaaatcgtaaaagggaacaacctgaccctgacaacgatgatagtcgtgggagaagccatagacaatcgggaagggctgtcacggttgtatgccgacgaattcaaacacctcttccgcacatgatcctactcttcggcggtactacggaaggccgtgccgcagctcgcgtgctggatgaagcgggaagtccgtttttctactccaccaaaggcaatctgcaagagatccagagtagccacggccatcgtctgacaggagccatgacggttgccgacatggtttcgttttgtcggaaagaagagatccgactgatcgtggacgccgctcatcctttcgccgaagaattgcacgcttcagtggcagaagcctctgaacaaacaggtatccccgtagtaagatacgagagacaataccctccacgcgaagaaggtatcgtctggtgtgcaaactacgatacggctgccgagcggatgcttggcgatggcgtgcagcgtctgctgatgctcacaggagtgaatacgatccccaagctggctgctttctggaaagagcgcaccaccttttgccgcatattgaagcgagacgaatcggttgctttggcagagaagaacggctttcctgcggagcgcatcgttttcttcgaaccgcatgcggacgaggagctgatgcaagccgttcgccccgatgccattatcacaaaagaaagcggagagagcggttacttccgagaaaagatagaagctgcccgacggatgggcatccgtatatatgccgtcgtacgtccccctttgcctccttcattcattcccgtaggcgggcctgtcggtttgagacgggcggtagaacgcctcgtgccgggattcttttcactccgaagcggattcactaccggcaccacagctaccgctgcagtagtagcagccatgtaccgattgatggggcttggctctctcgccgaagctcccgtagaattgccttcgggcgaaatagtcagtctgcccatagcggaaattcgagaggaagaagatgctgtcgtatccgcagtcctgaaagatgcaggtgatgatccggatgtgaccaatggcatggcggtatgcgctacgatcaggctcaatcccgaacatgaggaagtccgcttcctgcagggtgaaggggtgggggtagtgacgctccccggcctcggtctggaggtcggaggtccggctatcaacctcgtacctcgacgaatgatgacagcagaggtacgccgactctatgcgcagggaggtgtggatattacgattagcgtacccgaaggccgagaggctgctacccagacattcaatccccgactcggcatacgggacggcatctctattatcggaacatcgggagtcgtgaaacctttttcggccgaagcgttcgttggtgccatccgtaagcaagtgggtattgccaccgccttgggagccaatcatatcgtcctcaattcgggagccaagagtgagcgttatgtaaaaggagcctatccggcactcattccacaggcctttgtgcagtatggcaatttcgtcggcgaatcactcagttgtgtagcttccttcccttctgtccgttcggtaacggtaggaatcatgctcggcaaagcagtgaaactcgccgaaggctatctggatacgcacagtaaaaaggtagtgatgaatcgggatttcctgcacgaactggctcgtcaggcaggttgttcggaagacatccatgccataatagacagcctgaatttggctcgtgagctatggactatgccgagtgcggaggacagcgatcgactgctacgaaagattgccgaacgatcttgggaaacttgccgcccatcggtaccatcggccgaattagaactcctgctgatcgatgagtccggagcgattcgttttcgtatcggtggagaa

SEQ ID NO: 26 - DNA, 1353 bp, Porphyromonas gingivalis
caacaaagaccacatagaattattatgttgaggactttccgaatcggtggtattcacccccccgaaaacaagttgtcggcaggcaagcccgtagaggtgttgcctatcccctcacaggtagtcatccctcttggtcagcacatcggtgcaccggcaactgccacggtcaagaaaggggatgaagttaaggtcgggactatcattgctcaggccggaggattcgtatcagctaatatccactcatctgtgtcgggtaaggtgctgaagatcgataacgtatacgactcaagcggctatcccaagcccgcagtcttcattagcgtagaaggtgacgaatgggaagagggcatcgatcgctcaccagccatcgtcaaagaatgcaatctggatgcaaaagaaatcgtagccaaaatttctgcagccggtattgtgggtcttggcggtgctaccttccctacccatgtgaagctgtcccctcctccgggcaacaaagctgagatcctgatcatcaacgccgtagagtgcgagccttatctgacgagcgaccatgtccttatgctggagcacggcgaagagatcatgatcggcgtgagtatcctgatgaaagccattcaggtaaacaaggccgtcatcggagttgagaataataagaaagatgctattgctcacctcaccaaactggccactgcatatccgggcatagaggtaatgccgttgaaggtgcaatatcctcaaggcggtgagaagcagctgatcgatgcagtgatccgcaagcaggtaaaaagcggtgccttgcctatcagcacaggtgccgtagtacaaaacgtgggtacggtattcgccgtgtacgaagcagtacagaagaacaagcctctggtcgagcgcatcgtgacggttacaggaaaaaaactgtctcgtccgtctaacctcctcgttcgtataggtactcctattgcggctttgatcgaagcagcaggtggcttgccggagaatacgggcaagatcatcggcggaggtccgatgatgggacgcgctctgctgtcaccggatgtgcctgtgaccaaaggcagctccggagtattgattctcgatagagaagaggcagttcgcaagcctatgcgcgactgtatccgatgcgccaagtgcgtcggagtgtgtccgatgggactcaatccggctttccttatgcgcgacaccttatataagagctgggaaacagcggaaaaaggcaacgtggttgactgtatcgaatgcggttcgtgcagcttcacctgtccggccaaccgtcctctgctggattatatccgccaagccaagaagactgtgatgggtatccaaagagcacgtaagcaa

SEQ ID NO: 27 - DNA, 1467 bp, Porphyromonas gingivalis
atgaactctcaaaagaaagaggcttttaatatgaaaagaatacaactaactcttatcgctctcttcgccgctgttgccggtttggtcgctcaaaatgcttacgagggagtaatttcatataaaatttcgttggacaaaaccggaaacaaggttgtactgaatggtgcggcagatatgagtaatttaaagctcaagagcactcagatgatcattgttacgcctattcttcgttcagaagatggtaccagccgggtggaatttccttcggtagtcattacaggccgcaatagaacaaaagctctcaagcgtgaaatcgcatttagttcggctttgccccaagcaaaacatgcagctcaatacattcgccgtcataatgggaagagcgagcagtttgcttttacaggagaacatgcttatgcatcatggatgatggatgccaagtttgtggttcgtgaggaggtacgaggttgtgctaaatgccctgtaggtctctcgagtaatattgttccttttgatccactcttcaatccggcagaggctccttatttgttggcacacattactccggcagaagaagtggaaaaacagcgagagtccagcttcgatgcttatatcaacttcaaagtcaataaggcagatgtccttcctgagtatcgcaacaataaggcggagttagagaaaatcaaagaatttgtaagcaccgttaaggctaatccaaactattcggtcaataaaatgatcatcgaagggtttgcttctcccgaggcttcaatagcccacaataaggctttgtcggagcgccgtgctaaaagactcgcggaagaattggtgcgtaagtatggcaaaacattgccgaatataaccactgaattcggcggtgaagattggaaggggctgaaactggctatcgaaaagagtgatatagccgatcgtgaccgcgtattggagataatcaactccgataaatatgccgatgatgatgcacgtgaacaggctctgaagcaactttcgtcttatcgttatatcttggatcagatctatccgaatttgcgtcgcaatacgataaccatggggtatatcgttcgtgattataccctcgaagaagctcgtgaaatcattaagactgctccgaaagaacttagtgaggccgaaatgtaccgtgtggcaatgtcttatcctgaggggcaccaagagcgtttgtttgctctgaatacgacccttaagtatttccctgaaagtgtaacgggccgaatcaatttggctgtagccgcttttaatggtggagacgttcaacaggcaattgctctgttgagtccgattcagacagaaaagggtgtaagcaatatccttggagctgcttatgctcgtacgggagattttgctcgtgccgaaaccttcttccgtaaggccgttgcagaaggagatgcaaatgcgcagcgcaacctcgatatgctgcttggcaaaaag

SEQ ID NO: 28 - DNA, 1152 bp, Porphyromonas gingivalis
gacatggcagaaaaaagagactattacgaagtcctcggtgtatcgaagaatgccaccgacgatgaactgaaaaaagcatatcgcaagaaggctatccaataccatcctgataagaaccccggtgacaaggaggccgaagagcacttcaaagaggtagctgaagcctacgacgtattgagcgatccgcagaagcgcagtcaatatgaccagttcggccatgccggattgggcggagctgccggtggaggtttcagcggaggcggtatgtccatggaggatattttcagtcgcttcggtgatctattcggtgggttcggcggtttcggcggattctccgatatgggcggtggcagtcgcagacgtgttcgcagagggtctgacctgcgagtacgagtgaagctttctttggccgatataagtaaaggtgtggagaagaaagtgaaggtaaaaaagcaggtagtgtgcagcaaatgtcgtggcgatggcacggaagaagccaatggcaagactacctgccagacctgccatggaaccggcgtggttacacgtgtgagcaacactttccttggggccatgcagacccagagcacttgtcccacttgccacggagagggtgagatcatcacgaagccatgctccaagtgtaagggcgaaggtgtggagatcggcgaagaggtgatctcattccacatccctgccggtgtagccgaaggaatgcaaatgtccgtgaacggcaagggaaatgccgcgccccgaggaggcgtgaatggcgacttgatagtcgtgatcgccgaggaaccggatccgaatctgatccgcaatggcaacgatctgatatacaatctgcttatatccgttccgttggctataaaaggaggtagtgtggaagtgccgacgatagacggacgagccaagatccgcatcgaggcggggacacaacccggcaagatgctgcgtttgcgcaataaggggttgcccagcgtaaacggctatggcatgggagaccaactggtgaatgtcaatgtctatatccccgaatcgatcgatgccaaagatgagcaggctatcgcagcgatggaaaactcggacagcttcaaacctaccgatgctgctcgtaaggatatagacaagaaatacagagagatgctggat

SEQ ID NO: 29 - DNA, 927 bp, Porphyromonas gingivalis
cgattcgattcaacaactaatgtctcacaaattaatttaagaacagagatgaaaaaactgattttagcgactttgggacttatggccattgccatgctctcatgttcaagcaacaacaaggatttggagaacaaaggggaggctactcttttggtaacgtttggtagctcctataaagctccacgcgaaacctatgcgaagattgagaagacttttgccgcagcttatcccgatcaaaggataagctggacatacacgtcttctattatccgaaagaaactggctcagcagggtatttatatcgatgctccggatgaggctttggagaaattggctcgtctgggttataagaagatcaatgtacagagtcttcatgtgattcccggccgagaatatgatgagatgatcgactttgtcaataagtttaaggcagcacatagtgatattactgtgaaggtaggggctccgcttttcgataccgatgaagatatgcgcgaggtggcagagatcttgcacaagcgttttcagcaaacgatagagaaaggtgaagctattgtattcatgggacacggcaccgagcatgctgccaatgacaggtatgcccgtatcaataagatcatgaagaactatagcaagttcatgatcgtcggaaccgtcgagtccgatccctctatcaatgatgttattgccgaactgaaagaaaccggtgccacggccgtaacaatgatgccgctgatgagtgtggcaggcgaccatgctacgaatgatatggccggagatgaggacgatagctggaagacgttgctgaccaatgccggctacacagtttctatagacaagctggacaatggcaatttctcagctcttggagatatagaagagatccggaatatctggctcaagcatatgaaagccacctctgctcgc

SEQ ID NO: 30 - DNA, 1473 bp, Porphyromonas gingivalis
cggagagatgcgcggaggcaactggtacgccgtaggaggaaagagctatctggcacagcaaatacgcgatgccggaggagagtatttcctgaaagacgatcagcgatccggtggtgtttccctcgacttcgagacggtctacagccgatccgattcggctcgctactggcgaatcctcaacagctatcccggggagttcggttacgaagctttgaaagccgaagacagccgatatgccgatttcagggcattcaaggaaaaaggcgtgatatactgcaacctgagggaaacagccttctacgaactcatgcccatgcatcccgattgggtgctggccgatcttatcgctatcttgcaccccggactacttcccgaccaccaaccgcatttctattatttgctccaatgacatccgtcagccacttacgtacaatttctgtcgcaggtatcctggctgcgctgggaggggctgtactcattctcttcggggttaatctcttcctcggctcggtggctattccgatgagcgagatcttccgacatcttttttcagatcgtcccgaaggaggagaagcactcgtgcactacaatatcctatggaaatcccgcctgcccgaagccctcacggctgcttttgccggcgcaggtttatccgttagtggcttgcagatgcagaccgtctttcgcaatcctttggccggtccgtccgttctcggcatcagctccggtgccagtttgggtgttgctttggtcgttctgctgagcggctcgctgggaggagtggcattgagtagcctgggttatatgggcgaggtggccatgaatatagccgctgccgtaggctcgctggcagtaatggggctgatcgtttttgtcagcaccaaggtgcgcagccacgttacgctgctcattatcggcgttatgatcggatatgtagccactgccgtcatcggggtattcaagtttttcagtatcgaagaagatattcgggcatacgtaatttgggggttgggcagcttttcccgtgccacggattcgcaactgagtttctttgccattctgatgttgatctttattccggccggtatgctccttgtcaagcagttgaatctcttattgctgggagaaagctacgcacgtaatctgggactgaatactcgtcgggcacggctgctcgtgatctcttccgccggtttgctcatcgctaccgtcacggcctattgcggtcccatcggctttttggggatggctgtgccacacttggcacgggttatctttcacacatcggatcatcggatcctgatgcctgctacctgtttgattggaagtgctctggctcttttctgcaatatcattgctcgtatgccggggtttgagggggctttgcccgtcaattccgtaacggctttggtgggagcacctattatcgtcaccgttttgttccggcgcagacgcttcaaggaagaaaccgac

SEQ ID NO: 31 - DNA, 2289 bp, Porphyromonas gingivalis
cattttttagtaacgattatgcggacaaaaactatcttttttgcgattatctcttttattgctctattgtcgtcttctctgtcggctcagagcaaagccgttttaaccggtagtgtgtcggatgccgaaaccggagagcctcttgccggtgctcgaatcgaagtcaaacacaccaacatagtagccggtgccgatgccggcggacatttcgagatcaagaacctgccggcagggcagcatactattatatgttcgttgggggggtatggacagaaagaggaggtggttgccatcgaagccggacagaccaaaacgatctcttttgcattgcgactgcgaacgaacaacttggaggaagtcgtcgttaccggtaccggtacacgttaccgcttggtcgatgctcctgtggcaacggaagtccttaccgctaaggacatagcctctttctcggctcctacttccgaggccttattgcaggggctgagtccgtcttttgacttcggccccaatctgatgggctctttcatgcagctgaacggccttagcagtaagtatatcctcatccttatcgatggtaagcgtgtgtacggcgatgtaggcggtcaggccgatttgagtcgtatttctcctgatcagatcgaacggatcgaactggtgaaaggtgcttcgagttcgctctacggatccgatgccatcgccggggtaatcaatgtgatcacaaaaaagaatacgaatcgactgagtgcatatacgtcacatcgcatatcgaagtacaacgatcggcaaaccaatacttcgctcgatataaacatcggtaagttcagtagcaataccaactatttcttctaccatacggatggctggcagaatagtccgttcgaaataaaaaagaaaaaaggatccggcgaaccggtcttggaggaaacgtataagaaaacttttcgtgcacaggaaaatcagggtgtaagccaatcgctttcctattatgcaactaacaatcttagcttcagcggaaatgtgcagtacaataaacgtcagatcttcactccgactttttccgaaaagaaggcctatgacatggattatcgtgctttgacggcttcactcggtacgaactatcttttccccaatggtctgcatacgctttctttcgatgccgtctacgatcgcttccgtttcggatatttgtatcatgacaaggacagcagtgagagcctgatcaacaaccaaggtcagaccgagcaacccacattctttccgggtcagctacgcaataaaaacgatcagatccgatacacggcagaggctcgcggtgtatttacactgccttatgcgcagaaactgaccggcggtttggagtatttccgtgaggaattgatctctccctataatttgattaccgacaaggcagatgcttccacgctctctgcttatgtacaagatgaatggaaaccgctcgattggttcaatatgacagccggtttccgtctggtacaccatcaggagttcggtacacgaatgacgcctaaggtatccatactcgccaagtatgggccgctgaacttccgcgctacgtatgctaacggctataagactcccacgctgaaagagctttttgcacggaacgaactcaccactatgggttcgcacaatctctatctcggcaatgcggatcttaagccacagatgtcggattattatgctttgggcttggagtacaatcaaggccctatctcgttcagtgcaacggtttatgacaatgaacttcgcaatctgatctcctttatggatataccgacctcacccgagcacgaagctcagggaatcaagaaaaccaagcagtatgccaacataggaaaagctcgcagccgcggccttgatgtcctatgtgatgcctctatcggttggggtatcaagttaggagccggatacagcctcgtggaagctaagaatctccagacggatgagtggctggaaggagctgcacgtcatcgtgccaatgtgcacgccgattgggttcactactggggtcagtatagacttggcgtgagccttttcggccgtattcagagcgagcgttactacaaagacggcaatgctccggactataccttgtggcgactcgccacatcgcatcgtttcgctcatttccgccacatcatcctggatggaacgctcggtatagacaacctgtttgactacgtggatgatcgtcctatgggtgtcaattatgctaccgtaacgccgggacgtactttctttgctcaaatagcgattcgattcaacaac

SEQ ID NO: 32 - DNA, 1095 bp, Porphyromonas gingivalis
tgctgcgcaaggcttcgggacacctctccccggaagaagtcgtttcggaatgataccgtttttccttatttcgttattcatctgatcaaacatattatcattatgacggacaacaaacaacgtaatatcgtattcccggcgtttctcctcttgctgggagtcatcgcagtggtgacgatcgttggttttttcatgctcagaccggccgaggagattatccaaggacagatagaagtgaccgaataccgagtgtccagcaaagtgcccgggcgcatcaaggaacttagggtatccgagggacagcaggtgcaggccggcgataccctcgctgtcatcgaagcccccgacgtagcggctaagatggagcaggcaaaggctgccgaagcagctgcacaggctcagaacgccaaggctctcaaaggagcacgcagcgaacagatacaggcagcctatgagatgtggcagaaagctcaggccggcgtagccatagcgaccaagacacaccagcgcgtgcagaacctctatgaccagggagtggtaccggctcagaagttggacgaagccactgcccagcgcgatgcggccatcgctacgcaaaaagcggccgaagcccagtacaatatggctcgcaacggtgccgaacgcgaagacaagctggcagcttctgccctcgtcgatagagcgagaggagccgtcgccgaggtggagtcgtacatcaacgaaacctacctcatcgccccacgggcaggcgaagtgtcggagatattccccaaagccggcgaactcgtaggtaccggcgcacctatcatgaatatcgccgagatgggcgatatgtgggccagctttgccgttcgtgaggatttcctcagcagcatgaccatgggagccgttctggagactgtggtgccggctctgaatgaagaaaaagtacgcttcaagatcacattcatcaagaacatgggtacctatgctgcctggaaagcgaccaagacaacagggcagtacgacctgaagaccttcgaggtaaaggccacccttgcggataaagacaaggcacaaaagctacgcccgggtatgtccgtgatcatacgcaag

SEQ ID NO: 33 - DNA, 960 bp, Porphyromonas gingivalis
ccgcaatcctctcctgatcgaagaagcttccaaaacgtcatgaataaatatcattctcaaagcgttttagaggtcggcaaaattgggattgtgattatctttgcgcccatagtacggaatgtacatcaacaacccccttttttaagccataaatcaattatgcgtattgtcagtaattttttgttcgtctctttttcggttttgctttttgcatcatgccgttcccagcgagaaaaggtcgtttacctgcaagatatccaaacttttaatcgggagattatcgctaaaccatatgacgtaaaaattgagaaggacgatgtgctgaacatccttgtcagcagtagagacccggagctttcaacgccctacaaccaagtgttgaccactcgtgcactggcccgcaacggctatggaacgaactcgaacgaaggcttcctggtcgattcgaaagggtacatcaattatcctattttaggccagatctatgtagagggccttactcgtaccgaactggagaaggagatacagaagaggattatttccagtggatttatcaaggatcctacggtaacggtgcagcttcaaaatttcaaggtgtcggttttgggagaggtgaatcatccgggttcgatgtcggtaaaaggagagcgaataactcttttggaagcgatcggaatggccggagacctgacaatctatggtcgccgcgatcgggtttttgtgattagagaaaccgatgggcatcgcgaggttttccagacggatctcagaaaggccgacttgctcgcaagccccgtgtactatctgcatcagaacgacgtcatctatgtggagccgaacgacaagaaaacacagatgagcgagatcaaccagaataataacgtaaacgtatggctgagtgttacctccactttggtatccatttccacgctgacgattacgataatagataagaccaaa

SEQ ID NO: 34 - DNA, 1746 bp, Porphyromonas gingivalis
tcaaaaatagtactacgaaagttttgtaccttagcgcgcatgaaaaagaccaatctgtttttatctctgctggtgatctttatcaccggtagttttatgactgcctgtgcacagaagtccaagacgaacaaactcaccgaagaagatcggagccgcaatgagtatgtacagtcgatggatgtgcttagcaatattatcggtaacgtcaggctgtatttcgtcgataccataagtatcaaacatatgactcggcgtggtatagatgcgatgttgggcgggcttgacccctataccgaatacattccttacgaggaaatggatgaactgaaattgatgactacgggagagtatgccggagtcggagctatcatatcgcagcgcccggatagtgctgtgattatccagagacctatggaaggtatgcccgcagacgaagcaggattgatagcaggcgaccgcatcctgactatcgatgggaaagacttccgcaaatccaccacaccgaaagtaagccaagcactgaaagggatagccggtactgttgcaaaggtgacagtaatgcgctatggcgaaaccaaacctcgtactttttccgtgaaacgtcaaaaagtgattatgaattccgtcacttacagcggaatgctcgatggctcgataggatatatccgcttgaacaactttacggacaaaagtgcagaagaggtgcgcacggccttgttggatcttcgtgacaaacaaggagcgaaaggtctcattttggatttaagaggcaatggtggcggactgatgcaggctgctatcgagatagtcaatctgttcgtccctaagggcaaagaggtggtaacgaccaaaggtcgcattgcagagtcggcgtccgtatttcgcacattgactgaaccgatcgacacgaaactcccgatagtagtcctgatcgatggacaatcggcatcttcctcggagattgtagccggagcactgcaggatatggacagggctgtactgatgggacaaaagagctatggcaaagggcttgtacaaacgactcgtcagctaccatacaacggcgtgatcaaattgactacggccaagtactacatcccaagcggacgttgtattcagcgtttggactacagccgcaccaatcggacaggtatggcaacggccattcctgacagtctgcacaaaatcttttacactgctgccggaagacgtgtagaagatgcaggaggaatcctgcctgacatcgaggtcaaacaagatacagctgcgacattactttattatatggccatcaataatgacgttttcgatttcgtcacaggttatgtgctcaagcataaaacgattgccaagccggaggatttttccataacgaacgaggactatgcagctttctgcaagatgatggaagaaaagaaatttgactatgatcgccagagtggcaagatgcttgacaaactggaggaactggctaagatagaaggctacctgccggaagccaactcggagcttaaagcactacgcgaaaagctaaaacccaacctgtcgcgtgatctgctacgattcaaaaaggagataacaaactatctcaacaatgagattgtcactcgctattattatgagcgaggcagtatccgccagagtttgccggaagataaggtagtcaaagaagctattaagctgctgaaggaccatccggaacaaattcgacagatccttgcagctccgaaagcagagaataaaggg

SEQ ID NO: 35 - DNA, 2955 bp, Porphyromonas gingivalis
gtaacagacaaaatgcaaaacaaaggatttgtgattgttatcacatcggctctggccatcatctgtgcgttttacctgtcattctctttcgttacgaaccgttacgaaaagaaggctaaggcgatgggcgatgttgccggaatggcctatcttgattccatgtcgaatgagaaggtctggttcggctacacgctgaaagaagctcaagcccagcaaattggtcttggccttgacttaaaggggggtatgaacgttatcttgaaacttaacgcaagcgatctgcttcgtaacctctctaacaaaagtttggatcccaacttcaacaaagctctggagaatgctgccaagagcacggagcaatccgacttcatcgatattttcgtgaaggaatatcgcaagctcgatcccaacggtcgcttggccgttatcttcggttcgggtgaccttcgcgaccagattaccgcaaagtctacggatgcagacgtagtgcgtctgctcaaagaaaaatataatagtgctgtagaagcttcgttcaatgtgctccgtgctcgtatcgatgctttcggtgtggttgcacctaatttgcagcgattggaagggcaagggcgtatccttgtcgaactccccggagtgaaagaccctgagcgtgttcgtacccttttgcaacgcagtgccaacctacagttctggcgtacatacaaattcgaagaggtcagcggagacttgatcgctgccaatgatcgtctgagcgaattggctatgaacaacacggatgctaccccggaaacagagcctgcaactactgactctgtagctgcaacagccgattctgctgctgtacaagctgtagctgattctgctactgtagcacaaaaagaggccaaggatgctactcgtaaagacgcactcttctctctgcttactcccgtgaatcgtggcggtgcagtagtgggtgtggctcgtcgtgctaatatggctcagatatctgaaatgctccagcaagctcacgatctgaaggttacacgtgaagatgtgcttttcctctggggtgctaaagcaatcgaagaccccgaaaccaaaaaggagaccgacctctacgaactctatgctattcgtaccaatcgtacgggagatcctgatttgggaggtgatgtagtgacttccgccaagagtgatatccaaaatgacttcggtcgttccgaaccgatcgtttcgatgacgatgaatgaagaaggtgctcgtaaatgggcgcgtatcacaaaggataacgtgggacgggcaatcgctatcgttttggatggtgtggtttattctgctccgaacgtgaatgatgagatcacgggcggtcgctctcagatctccgggcacttcaccgtggaggaggccggtgaccttgccaacgtactcaactccggtaaaatggatgctacggtaagcatcgaacaggaaaacgtgattggtcctacgctgggtgccgagtccattaaagccggattcttgtcgttcctgctcgctttggttatcctgatgtgttacatgtgtctggcttacggtttcttgccgggtcttatcgcaaacggcgcattgattgtaaacagcttcttcacattgggcgtattggcttctttccatgccgtgctgaccctctcgggtatcgcaggtttggtgctgacgctgggtatggctgtggatgccaacgtacttatcttcgagcgtatcaaagaagagcttcgtgccggtaagactccgattcgtgccgttacggatggttatggcaacgctttctctgccatcttcgactcgaacgttacgactattattaccggtatcatcctattcctctacgggacggggccgattcgcggttttgccactacgttgattatcggtcttatcgcttctttcattacggctgtcttcttgactcgtatcgtcttcgagaaactggcgaaaaaaggtcgtttggataagattacattcactacgagcattactcgcaatctccttgtcaatccctcatacaacatcttgggtaagcgcaagaccggctttatcattccggtgattatcatcgttttgggacttatagcttcatttacaatcggtctcaataggggtattgaattctccggaggacgtaactacgtagttaaattcgaccagcctgtatcttccgaagccgttcgttcggccttgtcttctcccctgcaggaaaaggtattggttacctccatcggtactgaagggacagaggtgcgtatatctacgaactataagatccaggaggaaagcgaagaaactgaagcagagattactgacaaattgtatcagagcctgaaaggtttctacacccagcagcctactgctgatcagttcttggacaatatcattagctctcagaaagtaagtcccagtatgtcgagtgacatcacgagaggtgctatttgggctgtgctgttatcgatgatcttcatggccatttatattctgattcgcttccgtgacatttctttctctgccggggtattcgtatctgtggccgctactacattctgcattattgctctgtatgcgttgctgtggaagattctgcccttcaccatggagatcgatcagaacttcatcgctgctattctggctatcatcggttactcgctcaatgacaccgtggttgtatttgaccgtatccgagagacgatgaaattgtaccccaacagagatcgctatcaggtgatcaacgatgcccttaattcaacattgggtcgaacattaaatacgtctttgactacgtttatcgttatgttggtaatcttcatctttggaggtgctacgatgcgtagtttcacgttctcgatcctgctcggtatcgttatcggtacatactctacgctctttgttgctacaccccttgcctacgagatccaaaagcgcaagctcaacaaagcagctaagaaa

SEQ ID NO: 36 - DNA, 3138 bp, Porphyromonas gingivalis
gacttcccttgggttagggtaaaaccggagaagaaaagaaaacaacataacagtaataattttaagtttaacgcaaaagaaaagtctatgaaaagaatgacgctattcttcctttgcttgctgacgagcattgggtgggctatggcccagaatagaaccgtgaagggtacagttatctcctccgaggataatgagcccctgatcggcgcgaatgtcgtggttgtcggaaacaccactatcggtgctgcaaccgacttggatggcaacttcacgcttagcgtgcctgccaatgccaaaatgttgagagtgtcctattccggtatgactaccaaagaggtcgccatcgctaatgtgatgaagatcgtactggatccggactctaaggttctggagcaggtagttgtattgggttacggtacgggacagaaactcagcactgtttccggttctgtggccaaagtgtccagcgaaaagctcgcggaaaagcccgttgccaatatcatggatgccctccaaggtcaggtagccggtatgcaggttatgactacatccggtgaccctactgccgtcgcttctgtggagatccatggtacagggtcgttgggggcaagctctgcaccattgtatatcgtggatggtatgcaaacttctttggatgttgtggctacgatgaatccgaatgattttgaatctatgtccgttttgaaagatgcttctgcaacatctatttatggagctcgtgctgcaaacggagtcgttttcattcaaacgaagaaaggtaaaatgagcgagagaggtcgtattacctttaatgccagttacgggatttctcaaatcctgaatactaagccccttgataatatgatgactggagatgaattgctggattttcaggtgaaggcaggtttttgggggaacaatcaaaccgttcagaaggttaaagatatgatccttgccggagctgaagatttgtatggcaattatgattctttgaaagatgagtatggtaagacattgttcccagtggattttaatcatgatgcagactggctcaaggctttgtttaaaacagcacccaccagtcaaggtgatatttctttctccggagggtctcagggaacttcatattatgcctctataggctacttcgatcaggaaggtatggctcgtgaaccggcaaattttaagcgctatagtggccggctcaacttcgaaagtcgtatcaatgaatggctgaaagttggtgcaaatttgtctggtgcgatagcgaatagacgatctgccgactattttggaaagtattatatggggtcaggtactttcggtgtgttaacgatgcctcgttattataacccttttgatgtgaatggggatttagcagatgtctattacatgtatggagctaccagaccttctatgacagaaccgtacttcgcaaaaatgagaccgttcagttccgaatcacatcaggccaatgtaaatggtttcgcccagattactccgatcaaaggccttactttaaaggcacaggctggtgttgatattactaatactcgcacttcttctaagagaatgcccaataatccgtatgattctactcctcttggggaaagaagagaaagagcttatcgagatgttagcaagtcttttacaaatacggctgaatataagttttcaattgatgaaaaacatgatcttacagcattgatggggcatgaatatattgaatatgaaggggatgttattggggcatcttctaaaggatttgaaagtgataagttgatgttactgagccagggaaaaaccggaaatagtttgtctttgcctgaacacagagtcgctgaatatgcctatttgtctttctttagtcgttttaattacggttttgacaaatggatgtatatagatttctctgttcgtaatgaccaatcctctcgattcggatccaataatagaagcgcgtggttctattctgtcggtggaatgtttgacatatataataaattcattcaagaaagtaattggctcagtgatcttcgactgaaaatgagttatggtacaacgggtaactcggagattggtaattacaaccaccaagcactcgttactgtgaacaattatactgaagatgctatggggcttagcatttctacagcaggcaatcccgacctctcgtgggaaaagcagtctcagttcaacttcggtttggctgcaggggctttcaataatcgcttatctgcagaggtagatttctatgtccgcactacgaatgatatgttgattgatgtcccgatgccttatatcagtggtttcttctcacagtatcagaatgtaggctctatgaaaaatacgggtgtagacctttctcttaaggggacgatctaccaaaataaggactggaatgtatatgcttctgcgaatttcaactacaatagacaggaaataacaaagcttttcttcggtctcaataagtacatgttgcctaataccggtactatatgggaaattgggtaccccaattcgttctatatggctgaatatgctggaatcgacaaaaaaaccggtaagcagttgtggtatgttcctggtcaagtcgatgcggatggtaataaagttacaacaagccagtactcagctgacttggagacacgaattgataagtctgttactcctcctattacaggtggtttctccttaggtgcttcttggaaaggactttctttagatgctgattttgcctacatcgttggtaaatggatgatcaataatgaccgttactttacagagaatgcaggtggattgatgcaattaaataaagataaaatgctattgaatgcctggacagaggataataaagaaacagatgttccaaaattgggacagtctcctcagtttgatacgcatttgttggagaatgcttctttcctgcgtttgaagaatctcaaactcacctatgtactccccaatagtctttttgctgggcagaatgtgattggtggagctcgtgtctatttgatggcgcgcaatctgttaactgttacgaagtataaaggctttgaccctgaagcaggggggaatgtgggaaaaaatcaatatcctaattctaagcagtacgttgcgggtattcagttgtctttc

SEQ ID NO: 37 - DNA, 2607 bp, Porphyromonas gingivalis
tggcataggaatatttttatctttgcgagtacatttagcccgaaaaatatgctcccactgccataccgttatgcaaaaaccgagcacctttttctcgcaaaaggatactgcaagaatccaataacaaacataattatcctatttatgaagaaaaagaattttttgcttcttggcattttcgttgctttgctgactttcatcggcagcatgcaggcacaacaggccaaagattatttcaactttgacgaacggggcgaggcctacttctcattcaaagtgcctgatagggccgttctacaagagctggctctgatcatgtccatcgacgagtttgaccccgtaaccaatgaagccattgcctatgccagcgaagaggagttcgaggcattcctgcgctatgggctcaagcctacattcttgactcctccatccatgcagcgcgctgtcgagatgttcgactaccgctcaggagaaaaatacgaatggaatgcttaccccacctatgaagcctatatcagcatgatggaagagttccaaacaaagtatccatcactttgtactacttccgtcattggcaagtccgtaaaggatcgtaaactgatgatttgcaagctgacgtcctctgccaatacagggaaaaagcctcgcgtgctctatacttctacgatgcacggagacgaaacgaccggatatgtggtactgctccgactcatagaccatctgctgtcgaactacgaatccgatccgaggattaagaacattctggataaaacggaagtatggatctgccctttgaccaatccggacggagcatacagagccggaaaccacaccgtacaaggagctactcgctacaatgccaacaatgtcgatttgaaccgtaacttcaaggatgatgtagccggtgatcaccccgatggaaaaccttggcagccggaggcaactgcattcatggatttggaaggaaacacctctttcgtgctcggtgccaatatacatggaggaacagaggtggtgaactatccatgggataataaaaaagaaagacatgcagacgatgagtggtacaaactgatcagtcgcaactacgcagccgcttgtcagagtatttccgccagctacatgacctccgaaaccaattcgggaatcatcaacggttcagactggtatgtaattcgcggaagtcgtcaggacaatgcaaattatttccatcgtctgcgagaaattacccttgaaatcagcaacacgaagttggtgccggcctctcaacttccaaagtattggaatctgaacaaagaatctctgcttgctctgatcgaagaatccttatacggcatccatggtacagtgacttccgctgcgaacggacagcctctcaaatgccagatcttgatagaaaaccatgacaagcgcaactccgatgtttactccgatgctaccacaggctactacgtacgtcctatcaaagccggcacttatacggtgaaatacaaagccgagggttatcctgaggcaactcgtaccattacgatcaaggacaaagaaaccgtcatcatggacattgcattgggcaactcggttcctctgcctgtacccgatttcacagcttctcctatgaccatctcagtaggcgaaagcgtccaattccaagatcaaacgacaaataaccccacgaattgggagtggacgttcgaaggcggacagcctgccatgagtacagagcagaatccgctcgtatcctatagtcatcccggtcagtacgacgttacgctcaaagtgtggaatgcaagtggttccaacacgattacgaaagaaaaattcatcactgtcaatgccgttatgcctgtagctgaattcgtcggtaccccgacggaaatagaagagggccagacggtatctttccaaaaccaatccaccaatgccaccaactacgtatggatattcgatggcggcactcccgctaccagtgaagacgaaaacccgactgtgctttacagcaaagccggccaatacgatgtcacgctcaaggcgatcagtgcttccggtgaaacggtgaagacgaaagaaaaatacatcactgtcaagaaagctccggtccctgctccggtagccgacttcgaaggaacacctcgaaaagtaaagaaaggcgagacagttactttcaaagacttgtctacgaacaatccgacttcatggctttgggtgttcgaaggcggctctcctgccaccagcacggagcaaaacccggtggtcacctacaatgaaacaggcaagtacgatgtccagctgactgccaccaacgagggcggaagcaatgtgaagaaagcagaagactacattgaggttatcctcgatgacagtgtcgaggacatagtggcacagacgggtatcgtcattcgtccgcaaaacggaacgaagcagatcctcatagaagccaacgctgctatcaaagcgatcgttctctatgacatcaatggacgggtcgtactcaaaactactccgaatcagctccgctcgaccgtagatctttccatcctgcccgaaggaatctacaccatcaatatcaaaacggaaaaatccgctcgcacggaaaagatccatatcggg

SEQ ID NO: 38 - DNA, 318 bp, Porphyromonas gingivalis
ctttcgtacagtggagagagcgatgcaaaagagtctgatcagaattgccggaaatgtaccttcatcggctttgaaaaacgagtaaatacgatgcgactgatcaaggcttttctcgtgcaactcttactgctccccattttcttctacaagcggtttatatcgccgcttacaccgccttcatgccggtttaccccctcatgttcgtcctatgccatcgaagccttacgtaaatatggcccgggcaaaggactattgctgagcatcaagcgtattctccgctgtcacccgtggggtggaagtggctatgaccccgttccg

SEQ ID NO: 39 - DNA, 2583 bp, Porphyromonas gingivalis
ttagagatggcatacgactttacacaaacattccgcaacagcctggagtacagctatcaggaagcaacccgtctcggcgtcgtagccgtgacgcaagatatgctcgtactcggtatcattcgcgacggagacaatggcgcgatcgacatcatgcggcactatgggatcaacttgtacgaactcaaacggttgatcgagttggaagccatcgccgagagtttgcctgcttcgcctgagggatcgcccatcttcaccccttcggctcgggaggctatcgatgatgccacagacatctgtgccgacatggaggacgaggccgtcagcccggtccatctgttgctgagtatcctcaactcgacacaggagagcttagtacaaaagatatttatgaaacaaggtataaaatacgacaccatcctgtcggattacttcggacagcgcaacccctccgaagggaagtctccctccgaaatggagatcctcgacgggtaccaagacaacgacttcgacgacgaagaggacgaatcctctccgccttccgggaatagcgggacaggcggaggctccggcgacgcccccgaacagaataccggcggaggcgatactaccaccacgacacggagtggaggcgacacgcctgcactggacaccttcggcaccgacatcactgccatggcggcagcaggcaagctcgacccggtagtgggtcgggagcaggagatcgaaagggtgatacagatactcagccggcgcaaaaagaacaatccggtgctcatcggcgaacccggtgtaggcaagagtgccatcgtggaaggactggccgaacgcatcgtgaacaggaaggtgagccgtattcttttcgacaagcggatcatcagcctcgatttggctcagatggtagccggcaccaaatatcgcggacagttcgaagagcggttgaaagccgtgctcgatgagctgaagaagaatccgcagatcatcctcttcatcgacgagatacataccatcgtgggagcaggctctgcagccggatcgatggatacggccaatatgctcaaacccgctcttgcccgtggacaggtacagtgcatcggagccactacgctggatgagtatcgtaagaacatagaaaaggacggagcactcgaacgccgcttccagaaggtgccgatagccccctcgactgcagaagaaacgctgaccatcctgcaaaacatcaaagagaaatacgaggactatcacggtgtacgctatacggacgaagcgatcaaagcggcagtggaactgaccgatcgctatgtatccgatcgtttcttcccagataaggcgatagatgccatggacgaggccggcgcgagcgtccatatcaccaatgtggtggctccgaaagaaatcgagatactggaggccgaattggcatcggtgcgagagaacaagctctcggccgtaaaggctcagaactacgaactggctgcctccttccgcgatcaggagcggcgcactcagcagcagatagcggaagagaagaaaaaatgggaagagcagatgtccaagcaccgcgagacggtggacgagaatgtagtggcgcatgtagtggcgttgatgacaggcgttccggctgagcggctgagcacgggcgaaggcgaacgtctgcgcacgatggcagatgatctcaagaccaaagtagtaggtcaggacacagccatcgaaaagatggtgcatgccatccagcgcaatcgtctgggacttcgcaatgaaaagaaaccgatcggttctttccttttcctcggccccacgggggtaggcaagacctatttggccaagaagctcgccgaatacctgttcgaggatgagaatgccatgatcagggtggatatgagcgagtatatggagaagttctccgtttcgcgtctcgtgggtgcccctccgggatatgtgggctatgaagaaggcggccaactgacggagcgcgtaagacgcaaaccctattccgtggttctcttggatgagatcgaaaaggcgcatgccgatgtcttcaatctgctcttacaggtgatggacgaaggtcagctgaccgacagtctgggacggcgcgtgaatttcaagaacaccgtgatcatcatcacctccaacgtgggtacacgccagctcaaagacttcgggcagggtatcgggttccgttcggaaaaagacgaggaagcgaacaaggagcatagccgttccgtgatccaaaaagctctgaacaagacgttcagccccgaatttctcaaccgtttggacgatatcatcctcttcgaccaactgggcaagacggagattcgccggatggtggacatagagcttaaagccgtcttggcgcgcatccatcgtgccggatacgacctcgtccttaccgatgaagccaaggatgtgatagcgacgaagggatacgacctccaatacggagcacgaccgctcaagcgcacactccagaacgaagtggaggatcgcctcacggatcttatcctctccggacagatcgagaaagggcagacgcttacgctctctgctcgcgatggcgagatcatcgtacaagaacaagca

SEQ ID NO: 40 - DNA, 1368 bp, Porphyromonas gingivalis
agaggaggacaaatccgccgacaccataccgattcgtcaaggggatcggacagcaaagcctgccgcttctcctttcatgccgagaccatcggtttctccaaccaccaaagagcaaaaatgaattacctgtacatactgattacacttttactctccggctttttttccggtgctgagattgctttcctttcttcggacaaactgcgtcttgagttggacaggaatagaggcgatctcacaggcagagcgttaaacttgctgtatcgacatccggaccaactggtgactactctccttgtgggtaataatatcgttttggtagtctatggtctgctgatggcgggattgctggccgcacctttggcgcaatggattgataacgatgctatgatcgtcgttctccaatctgtcttatccactatcatcatactgtttaccggggaatttctacccaaagccattttcaagaccaatgccaatatgatgatgagggtattcgccctccctatcgtagcgatctattatctgctttatcctctgtctaaactcttcaccggtttatctcgctcttttattcgtctggtggacaagaattatgtgcctacaacagtagggttggggcgcgtagatctcgatcattatttggcagaaaatatgtccggagaaaacgaacagaacgacttgactaccgaagtgaaaatcatccagaatgcgctggatttttccggtattcaggtgcgagactgcatgatcccacgcaatgagatgatagcatgtgagttgcaaacggatattgaagtactcaaaacgacttttatcgataccggtttgtccaagatcattatctacagacagaacatagatgacgtagtaggatatatccattcgagcgaaatgtttcgtgggcaagactggcaaaaacgtatcaatactactgtattcgtacccgaaagcatgtatgccaataaactgatgcgactactcatgcagcgcaagaaaagcattgcgatcgtcatcgatgaacttggaggtacggccggaatggtcacattagaggatttggtagaagagattttcggtgacattgaggacgaacacgacactcgcaagatcatagccaaacagctcggccctcatacctatctggtcagtggtcgtatggaaatagatgatgtgaacgaacgttttgggttgtccttgcctgagtctgacgactaccttaccgtggccggatttatcctgaatagccatcaaaatatcccacaggccaatgaggtcgtggagattgctccttatacttttaccattctcagatcttcttccaccaagatcgaactggtgaaaatgtccatcgacgaccaatcgaac

SEQ ID NO: 41 - DNA, 897 bp, Porphyromonas gingivalis
ttaaaaaaggagataactatgaaacagaactacttcaaaagagtctgctcactgctttggctggttttacccatgcttattatgccattggaagtagcagctcaagagattattccgaacgaagaggtgttggaatcattgactttcgttgcaccggttgaggagacagacgcaatagaggcagaggtagaagctctgcaggagatagtcgctactgaggagattgcggagcaggctgttcgttcttatacctacacggtctatcgtgatggcgtgaagattgcttcaggattgactgagcccacttttctcgatgaagatgttcctgccggcgaacatacctactgcgtagaagtacagtatcagggaggcgtatccgacaaagtatgcgtggacgtagaggtgaaggacttcaaaccggttaccaatctcaccggaactgcttccaatgacgaagtttctttggactgggacggtgtggaagagaaagctgaagagccggcaagtgataaagcagtcagctacaacgtctacaagaatggaaccttgatcggtaatacagctgaaactcattatgtggagaccggtgtagccaatggtacatacatctacgaagtggaagtaaagtatcctgacggtgtatctccgaaggtggctgtaaccgtgaccgtgaccaacagctcattgagcaatgtagatggacaggctccttacacattgcgagtagaaggcaagaagattattgcggaagcccatggtatgatcacgctctacgacatcaacggacgtaccgtggccgtagccccgaatcgattggaatacatggcgcaaaccggtttctatgcagtgcgcttcgatgtggggaataaacaccatgtatcgaaaatacaagtaaga

SEQ ID NO: 42 - DNA, 1131 bp, Porphyromonas gingivalis
ttgtttaatcataaaaaatcatggtatgaaacatttcaattttatctcgttgttttccgctctggctttattcttttgtgtgaaaatacccttgcacaacaaaaaacagaggagtttgcacctgtgtcggatttacgtgcagaagcgtacggctctaccgttttcctccactggactccgccgtatgacaatccgatgattcctctaagcgagagttttgaatcaggtattccagctatatggaagaccattgacgcagatggcgatggctataattggatgcatttgaccaatttcacgggacagagtggtctctgtgtctcttcggcttcatacataggcggcgtcggagctttgactccggacaattatctgataacacccgaattaaaactacccacagacgcgttggtggaaataatctattgggtatgtactcaagatctcactgctccatcggagcactatgccgtttattcctcttctacaggcaataatgctgctgactttgttaatctcttatatgaagagactttgactgccaaacggatacaatcccccgagttgatccgcggaaatcggacacaaggtgtttggtatcaaagaaaggtggtactccctaacgatactaaatatgttgctttccgccattttaattccacggataatttctggctcaatttggatgaagtatctatcctgtatacccctcttccccgaagagctccgtgtccgcatccgggtggttacacttattctgtattccgtgatggacaaaagatagcgagtggattgtcggcattggcatatatcgatacggatgtaccgtatgggactcaagactattgtgtccaagtcaattatctgcaaggagactcgtataaagtctgcaaaaatatagtggtggcaaattctgcaaacatctatggggcggataagccttttgcgttgaccgtggttggcaagaccattgtagcgagtgctttcaaaggagagatcactctttatgacattcgtggccggctgatagcttccggctgcgatacgcttaggtacaaagcggaaaatggtttttacctcattaaaatacaggtaaacggaactgtctatactgagaaaatccaaatccaa

SEQ ID NO: 43 - DNA, 2547 bp, Porphyromonas gingivalis
ttcggaatatcaccttcaatgaaaaaaagttttcttttagccatagtaatgctctttggcattgccatgcagggacattctgctccggttacgaaagagcgagctttgagtctggctcggctggctttgcgacaggtatccttgcgaatgggacaaacagcagtatctgacaagatttccatcgattacgtttatcggcaaggagatgctgagaggggtatcacatcacaagaggaaggctctcctgcatatttttatgtagctaatcgtggaaataatgagggctatgctcttgtagcagcagatgacagaataccgacaattttagcctattcacccattggccgtttcgacatggacagtatgccggacaatcttcgcatgtggctacaaatttacgatcaggaaataggcctgatactttccggaaaagctcagctcaatgaagagatattacgtaccgagggcgtaccggctgaagtacatgctctgatggataacggtcattttgccaacgatcccatgcgatggaatcaaggttacccatggaacaataaggaaccactgcttcctaatggcaatcatgcctataccggctgtgttgctactgctgcagcacaaatcatgcgctaccatagctggccgcttcaaggtgaaggctctttcgattatcatgcaggttcattagttggcaactggtccggcacatttggtgaaatgtacgactggatcaatatgcccggaaatcccgaccttgataatctgactcaatctcaagtggatgcctacgccacactgatgcgtgatgtgagtgcatctgtttcgatgagtttttatgaaaatggaagtggtacgtacagcgtttatgtagtaggagccttgcgaaacaactttcgctacaagcgttcactgcagctacatgtacgcgccttatatacctcacaggagtggcacgatatgatccgcggggaacttgcctccggaaggccggtctattatgcagggaataaccagagcataggacatgctttcgtttgcgatggttatgcttcggatggtactttccatttcaactggggttggggaggtgtttccaacggcttctacaaactaacactcctctcgccgacttcgttgggtatcggaggtgagggaataggttttaccatttatcaagagatcatcaccggtatcgaaccggctaagactcccgctgaagccggtacagatgccttgccgatcttggcactgaaagacatagaagccgagtataaaagtgaatccggattgaacgtagggtattcgatatataatacaggtgaagagcaatcaaatcttgacctcggatacagattgaacaaggctgacggagaagtcatagaggtgaaaacttcatctatcaatatctcttggtacggatacggagagcatcccgagagtttctcattggcacctaatcagttgtcacaaggaatcaacaccatcaccctactttatcgtcgcacaggcaccgaacagtgggagccggtacggcatgcacagggaggatatgtcaatagcattaaagtaaatacgacagacccgaacaatgtcgtagtcacggtagataataacgaaggcaagctcagtatcgtccccaacagctttgtcgcagatctgaattcttatgaacatagtacgattacagtacagttcaatagcgacagccctgatgagatccgtacacccgtagcctttgctctatctacaggagctactgcggacgatgtaatatctttgggctgggtaatggctgaagttccgggcggtagcagcaactatccggtggtttggtctaaagacgttctcactctctcggaaggcgactatacattgtggtatagattttccatcaacaaccaaaaggatgaatggaaaaagatcggaagcgtgtcagtaaaaacaccgacagagtatacgcaccccttattcgaagtgggccataatcaaacttctacctatacgctggatatggcacacaacagagtattgcccgactttacactcaaaaatctcggattgcctttcaatggtgagttggttgttgttttccgccaaacacaatcctcatcggggtctttatgggcagctcaagaaacagtacatatcaagcaaggagaaactttcgtatataaacctgttgtcgaaggccctatacctgatggatcctatcgtgcgaccctccatgcattcgtaaacggacaacaacagttgtacctcaaggggaaaaggaactacacggtgaagatcgtcaatggtacagcggtagaagcaatagaatcgtcagaagagatcagagtattccctaatccggcacgcgattatgtggaaatatcggcaccttgcattccccaagaaacatctatcattcttttcgatctgtcaggcaagattgtcatgaagaatagtttatcagcggggcatggcagaatggatgtcagccgacttcctaatggggcctacatccttaaggtggatggatatacgacgaaaataaatatagtgcac

SEQ ID NO: 44 - DNA, 885 bp, Porphyromonas gingivalis
acgaagaaaacactgatgaaaaagctatttctctcgctcacgagtcttgtaatggtcttcgctgttgcaagttgcgatataatcgacaaggatcaaaccctcttgccggctccgaccaatgtgacacccgataatccggatgacaatccttcggagatcgacattacgcagacgcacacagaaaaatatgttttggctgaagaatttaccggccaaaaatgtctcaactgtccgaaaggtcatcgcaaactggcggctctcaaggagcaatacggtaagagattgactgttgtcggtatacatgccggccctggatctctcgtgccacctcttttccgtacagaagccggagacgcatattatagcaagttcgccaataatacccctctccctgcgctgatggtttcgcgcaaaaagttcggctcttcctacgtttatgataagagctacaaaacgtgggacgtgcctattgccgagcagatggagcaaaaggcgaagatcaatatctttgccgtggccgaatacaccgatacccaaaagatcaaggtgactgtaaagggtaaaatactggaggggaatacactcccgaagtccatggttcaggtgtatctgttggaggataagctgatcgctccgcaggtggatggcaatacgacagtcgagaattacgagcacaatcacgtgttgcgtggagccgttaatggtatttggggcgaagaatttgtgaatctcaaagattatttgtatacttacgccgttgaaccgctctcgggtatgtccttcgtagccgagaattattcgattgtggcttttgtatacgatgtgcagacgttcgaagtgtatgacgttgtgcatgtaaagatcaatccgcaatccgatggcaaa

SEQ ID NO: 45 - DNA, 690 bp, Porphyromonas gingivalis
acgaataaaaaagaagagacaatgaagaaatcaagtgtagtagcctcagttttggccgtggctctcgtgttcgccggttgcggactgaacaatatggcaaaaggcggccttatcggcgccggagtaggaggtgccattggtgccggagtaggtaacgtagccggaaatacggctgtcggtgccatcgtcggtactgcagtcggtggagcagccggtgctctcatcggaaagaagatggacaagcagaaaaaagaactggaggccgcagtacccgatgctacgattcagacagtaaatgacggagaggctattctggttactttcgatagcggtatcctctttgcgacgaactccagcactctgagtcccaactcacgcactgcgctgacgaagtttgctgcaaacatgaacaaaaaccccgacacggatattcgtatcgtaggccatacggacaataccggctccgacaagatcaacgatcctctgtctgagagacgtgcagccagcgtatattctttcctgaattctcagggtgtgagtatgtcgcgcatggcagccgaagggcgtgggagccatgaaccggttgcagacaatagcacagttgccggacgttcggccaaccgccgtgtggaggtttatatcttgccgaatgccaagatgatcgaacaagcacagcaaggtacgctgaag

SEQ ID NO: 46 - DNA, 1026 bp, Porphyromonas gingivalis
aacaggaacagaaatatgtcgaaaaaatcgatccttctgctttgctgttcgctgtgcttcatttctgctacgaaggctgtgacccccgtcagaaatgtgcgcaatagccaagtgaacagcaaagcaaagaccgaacgtacaaagccctcggactctgtacggtacattagcaacatgattgcagatcggctggagttccgcaacaagatttcttccgaaaaagaggtaagaaaagccgaatatgaaaatcggctggcgatggaagcactcaattaccctgccatagatttatatggtgaagattcttggagcgagtatgtaaaccctttcgtgggtgcaggaaccgatgtcgaaattccgaactcctatgacattgattgctcttcgttcgtgatgcccgtcgaagataagcaggtcacctctcaatttggctaccgtcggcgtttcggacggatgcactatggtattgatctttcagtgaatcgtggcgatacgatacgagcagcctttgacgggaaagttcgtgtacgcagctatgaagcgcgtggctatggctactacatagtcttgcgccatccgaacggactggagactgtgtacggacacatgagtcgccaattggtagacgagaatcagatcgttcgagcaggacaaccgatcggattaggaggcagcacgggtcgaagcaccggtcctcatcttcacttcgagacccgcttcatgggtattcccatcaatccgagtaccattatagacttcgataacggagtgccgctccgagacatttacacattcaaacgagggagcaattctcgctatgcaaaagcctctaagacttcttctcgctatgcaaaaaaagggaagaaaggcagacaagcttcttctcctatgacctatagaatcaaaaaaggcgatactttggaaacaatagccaaaaggcacggcacttctgttcagaaactctgtgctaccaatggcattggcaagagtaaaattttgactccgggcaaagccttgaggatcaaa

SEQ ID NO: 47 - DNA, 477 bp, Porphyromonas gingivalis
ccgagcaaaacgataattaagacaatggcaaaaatcaatttctatgctgaaggcgtcagccttcctcggatcagaagacggatcgtcggtaagtggatagccgaagtatgcagccgatatgggaaagcggtgggagaaatctcctatcttttctgtgatgacgaatatatcctgaaagccaatcaggaatttctcgatcatgactactacaccgacatcatcaccttcgattcctgcgaagcggatacggtgaatggcgacctgcttatcagtctcgataccgtacgctcgaatgcccgtgctcttgatcttcgatacgaagacgaactgcatcgtgtcattatccacggcatactgcatctttgcggattgaaagacaagagcaaaaaggatgaagcccaaatgcgtgcagccgaagagaaagcccttgtcatgctgcgagaaaccatcggatcggagctttccctattgcataca

SEQ ID NO: 48 - DNA, 1185 bp, Porphyromonas gingivalis
  modified_base (735)..(735): n is a, c, g, or t
aaaagtaaaactatgaaggtaaagtacttaatgctcacattggttggagcaattgcactgaacgcaagtgcacaggagaatactgtaccggcaacgggtcagttacccgctaagaatgttgcttttgctcgcaataaagcaggcagcaattggtttgtaacactgcaaggcggtgttgcagcgcagttcctcaatgacaacaacaacaaagacctcatggaccgcttaggagccataggttctctttctgtcggaaagtatcacagccctttctttgcaactcgtttgcaaattaacggaggtcaagcccacactttcctcggaaaaaatggcgaacaagaaatcaacaccaattttggtgcagctcacttcgactttatgtttgatgtggttaactactttgcaccatatcgcgaaaatcgtttcttccatttaattccatgggtaggtgttggctaccaacacaaattcatcggtagcgaatggagcaaagacaatgtggaatcactgacggcgaatgtaggagttatgatggctttcagattaggaaagcgagtagactttgtgatcgaagcacaagcagctcactccaatctcaatctaagtcgcgcatacaatgccaagaaaactcccgtattcgaagatcccgcaggacgttattacaatggattccaggggatggctacagcaggtcttaatttccgcctgggagccgtaggcttcaatgccattganccaatggactacgcacttatcaatgatctgaatggtcagattaaccgtttgcgcagcgaggtcgaagaactctcaaaacgtcctgtatcatgccccgaatgtcctgaagtaactcctgttactaagacagaaaatatactgacggaaaaagctgtactgttccgtttcgacagccacgttgtggacaaagatcaattgatcaacctgtatgacgtagctcagtttgtaaaagaaactaacgagccgattaccgttgttggttatgctgatcctacgggtaatactcaatacaacgagaaattgtctgagcgtcgggctaaagccgttgttgatgttctgacaggtaaatatggtgtgccttccgaattaatctctgtagaatggaagggcgactctacgcaaccgttcagcaagaaagcttggaatcgtgttgtaatcgttcgctccaag

SEQ ID NO: 49 - DNA, 1161 bp, Porphyromonas gingivalis
tataaaatgacatacagaattatgaaagctaaatctttattattagcacttgcgggtctcgcatgcacattcagtgcaacagcccaagaagctactacacagaacaaagcagggatgcacaccgcattccaacgtgataaggcctccgatcattggttcattgacattgcaggtggagcaggtatggctctctcgggatggaataatgatgtagactttgtagatcgtctaagtatcgttcctactttcggtatcggtaaatggcatgagccttatttcggtactcgtctccaattcacaggattcgacatctatggattcccgcaagggagcaaggagcgtaaccacaattactttggaaacgcccaccttgacttcatgttcgatctgacgaactatttcggtgtataccgtcccaatcgtgtcttccatatcatcccatgggcaggtataggatttggttataaattccatagcgaaaacgccaatggtgaaaaagtaggaagtaaagatgatatgaccggaacagttaatgtcggtttgatgctgaaattccgcctatcaagagtcgtagacttcaatattgaaggacaagcttttgccggaaagatgaactttatcgggacaaagagaggaaaagcagacttccctgtaatggctacagcaggtctaacgttcaaccttggcaagacagagtggacagaaattgttcctatggactatgctttggtcaatgacctgaacaaccaaatcaactcacttcgcggtcaagtggaagagttgagccgtcgtcctgtttcatgccctgaatgccctgagcctacacagcctacagttactcgtgtagtcgttgacaatgtggtttacttccgtatcaatagtgcaaagattgatcgtaatcaagaaatcaatgtttacaatacagctgaatatgcgaagaccaacaacgcaccgatcaaggtagtaggttacgctgacgaaaaaaccggtactgcggcctataacatgaagctttcagagcgtcgtgcaaaagcggtagccaagatgcttgaaaagtatggtgtttctgcggatcgcattacaattgaatggaagggctcatcagagcaaatctatgaagagaacgcttggaatcgtattgtagtaatgactgcagcggaa

SEQ ID NO: 50 - DNA, 585 bp, Porphyromonas gingivalis
gtaattggcatcattatggaatttttcatgttattcatagcggcggttttcgttaataacgtcgtgctgtcgcagttcctcggtatatgcccattcttaggcgtatcgaagaaggtagacacctcaatcggtatgggtgcagccgtgacattcgtattggcactggctaccttggttaccttcctgattcagaagttcgttttggatcgtttcggattgggctttatgcagaccattgcatttattttggtcattgccgccttggtgcagatggtggagatcatactcaagaaagtatctcctcccctctatcaggcactgggtgtattcttgcccttgattacgacgaactgctgtgtgctcggtgtggctattttggttatccagaaggattataccctgctccagagcttcgtctatgcaatatccacggctatcggtttcaccttggcaatggttactttcgcaggtattcgagagcaactcgatatgaccaatctccccaaagctatgaagggaataccttcggcactcttggctgccggtatattggctatggctttcatgggcttcagcggtatcgcc

SEQ ID NO: 51 - DNA, 2628 bp, Porphyromonas gingivalis
taccgatcttatcgtgggatagggagtgggacacactctcctaacctcaaaaaccgactaaaaaggatcggaataaggataccgaacagacactatatccatatcaagccaatcaaaccaaaaaataaaatgaaacaactaaacattatcagcttcatcattgctttcctattcttaggaacgagcgcatcggctcagcaatcgggcggatccgttacaggtaccgtagtggacaaaagctcaaaagaacctatcgcatacgtacaagtattcgtcaaaggaaccactctcggaacttccacggatgcaaacggaaactactcgatcaagggaatcccttcgggtaatcaaactatcgtagcccgactcatgggttactccacttgcgaagaaaaagtacatatagaaaagggtggttcccgccacgtagacctctatctgaccgaagagattctctctctcgatggggtagtggtatctgccaatagaaacgagactttccgccgtcaagcaccctcgttggtaacggtactgtcgccggaacttttcctcaaaaccaactctaccaacctgagtcagggacttaagttccagcccggtctgcgcgtggaggacaactgtcagaactgcggtttcaaccaagttcgtatcaatggactcgaaggagcctattcgcaaattcttatcgacagccatcccatcttcagttcgcttgccggtgtctatggcttggagcagatgcctgccaatatgatcgaacgtgtagaagtaattcgcggtggaggttcggctctgttcggctctaatgctgtgggaggcgttatcaacgtaattacgaaagaaccgcttcgcaattcggccgagatcagccattctacgatgaccttcgaccacgcgaaagggtgggggagcttccaaaatacgacccagttcaacggttctatgctgacggaagaccgcaaagccggtgtcatggtattcggccaacacaactaccgtcccggacaggatatagacggcgacaactttaccgaactacccaatctgcgcaaccgctcgctcggtttccgctcatactataagaccggtctctacagcaaagcaaccctcgaatatcacagcatgcaggagtaccgtcgtggtggcgacagactggacaatcctcctttcgaagcccagatagcggaatatctccagcactatatcaatggcggaagtttcaaattcgatcagggcttcagcggtggcaaggatttcttcagtctgtatgcttcagcacaagacgttcagcgtcgtagctactacgggggtggcgactataccgaaaatctgctgaacggagcagttcagagtggaagcaccgaatcggacgaatacaacgatgctttcacggctcttacttcctacgggactaccaagggattcgatttgcaaggaggaggtatgtaccgtcataccttcggagaaaactgggactttaccggcggactcgaatatatctacggccaactcgatgacagaagcggctacagaccgagcaaaatagatcagaatacctctacttttagtcagtacgaccagctcgaatataagacggagaagttaagtgcccttatcggagcacgtatcgactatgttctcctcaatcaggatggcaaacgctatatcgatccgctcttcattttcagtcctagagccaacgtacgatacaatcccaataagaatctcagcttccgactctcatacagcgaaggattccgcgctcctcagtatttcgatgaagatctgcacgtagagttggccggtggtactcctatcagccgtgtcctttcccccaatctgaaagaagaacgttcacgaagcatcagtgcttctttcgattattaccacagagccgacgaatggcaattcaatatcatgggagaagccttctccacctttatcagcaatcagttcaaaccatccgataaggtcgaaaccacgagcgatggcaaagaatggatcattcgtaccatctacaacgacaaggatggagtatcgaaggtatatggtgtgaatctggagggaagaatcgcctacaacaaatcgttcgacctccagctcggcggtacatggcagagaagccgctacggaagcatctataccgctgtggaagcggacaaaacaacgggacaagccgagatctctgtgaaagactatgtacgcactccgaatctgtacggctatttcgttgctacggtacgtcctaccgagcacttcgccatcaatctctccggtacattcacgggcaaaatggatgtagtacacgaagcctatgaaggcgatattcccgcagaacacatagctccggacggatcgttcgactttgaaatgaatggtcagcaattcaaaggtttggccgaaggtcatgccaagctcgtcaagactccggccttcgccgatatagacctcaagctgagccacgacttccaccttgcttccactatgaccttggaattgaatgccggaatacagaacatattcaacagctatcagaaagacacggacaagggaccgggtagagcttctacttacgtatacggtcctatgcagcccagaaggattttcgtcggtacaaagatcaatttc

SEQ ID NO: 52 - DNA, 2697 bp, Porphyromonas gingivalis
atattgaatcatttgagaaagactatgtacaaaaagattattgccgtagcagctctcttctgcgccagcatagggatcctgaaaggacagtcctcggatctgacccctcaggatactatatatagccctgaaatatcctatgccaagcctattcataagaccatagcatctattgagatcgagggaatgaggtctttcgatgactttgtcttgcgcaatctttcaggcttggctgtaggtgatgaagtcctgattcctggagatgccatgtctgctgccgtgaatagaattatgcgtcagggctacttctcaaatgtgcgaatcatcgcggataaatatgtcggcaataaagtctatctgaaaatcattgtcactgaacgtcctcgcatcagtaaggttacttttagcggggtaaagaagtctgagagagaagatcttgaaatgaaaatcggtcttcgcgaggggattcagatgaccagaaataatgaagacaaggtcaggcaaatcgtacagaagtattttagtgagaaaggttatcgcgatgccagcatacggataacgcaggaaccggatctttccaaagatggctttgtcaatgtgcttatctcgattgagaagaaaagcaaaaccaaggtgaatgaaatttatttttccggcaacaaggcccttagcaatcataagctaagaatggcgatgaagaacaccaatgccaaattcagtcttagaaagcatattcgctcatctttcttgaaactttttagtactcataagtttgtggaagagagctaccgtgaagatttggtccgattgatagagaagtatcaggaatatggatatcgtgatgctgaaatactgaccgacagtgtcgtgaaggctcctgacggcaaaagagtggatatttatctcaacatcgaagaggggcagaagtattatattaaggatgtcaactttgtgggcaattcacaatatccatcggagtatttggaacgagtgctcggaataaaatccggagatgtgtacaatcagagacgattggctaagcgtctcaatgaagatgaagatgctgtggggaacctgtactataacaatggctatatttttgcgtgggtcgatcccgtggaaacaaatgtagtgggggattctgtttcgcttgatattcgtatagcggaggggaagcaggccaatatcaataaggtgatcatcaaaggaaatactgtcgtgtacgaagacgtagtacgccgagagctttacacaaagcccggccagctctttagtcgcgaggatatcattaactctattcgtctcatcaatcagcttgggcatttcgatgccgaaaaatctattccccgtccgattcccaatcccgaaacaggaacagtggatatagagtatgatttggtgccgcgtagcagtgaccaattggagctttctgtcggttggagtcagtccggacttctgttccgaggagccattaagttcacgaacttctctgtcggcaacttgctccatccctcgatgtataagaaagggatcattccgcaaggggatgggcaaacactatcactgagtgctcagaccaatggaaagtactatcagcagtatagtgtcacatttatggatccatggtttgggggcaagcggccggatatgttcagcttcagtgcattctattccaagactacggcgattgactccaagttctacaatagcaatgccggcaactactataatgcctactataatagctactacaacaactataatagttattacaacggtatgtcgaactataccggcgacctctatactcaggccagcgatccggatcgttcgcttcagatgttaggtacttcgatcggttacggtaagcgtttgacttggccggacaattggttccagatttatacttctctgaactacacctactatagactgcgaaattggagctacaataccttccaaaatttccatcatggctcggctaatgatctcaacttggagctgcgtctctctcgtacttccatcgataatcctatttataccagaagcggatcggatttcatggtttctgttgctgctactcttccttattctttgtgggacaatcatgactatgccagccagaacctcagcgtaagcgatcgttacagatttatcgagtatcacaagtggaagtttagaggacgagtttttactccattgctcaatcctgctacgcataaatatacaccggtgctcatgagtcgagtggaaggagcagttcttggttcgtataattccaataagaaatctcctttcggtactttctatatgggaggtgatggtatgtccagctattatggtggctacatgaatgagactataggtttgcgtggttataagaacggatctattgccggtaataactacgactatgcatatgcttatatgcggcttacgatggaactacgtttcccgattctgtttgaaaactcattcaatgcgtggctcttagcttttgccgaagcaggcaatgcgtggcgcagtatcgacaattataatccctttaacctgaagcgatcggccggtgtaggattgcgtgtaacgttaccgatggtcggaatgctcggtatcgattggggatatggctttgaccgtccggacaattctctacagcgaggaggaagcaatgtccactttgtgctcggacaggagttc

SEQ ID NO: 53 - DNA, 531 bp, Porphyromonas gingivalis
caaataaacatgaatggcgatatgaaacggtttttgattttgatcggctttgcactggcggtagctttctccggtttttcccaaaagttcgctttggtagatatggaatatatcctcaggaatattcctgactatgagatgatgaacgaacagctggaacaggtgtccaagaaatggcaaaatgaaatcgaagctctcgaaaatgaagcccaatctatgtataagaagtatcagagcgatctcgtattcttgtctgctgcacagaagaaaacccaagaagaggctatcgtaaagaaagagcagcaagcatccgagctcaagcggaagtatttcggcccggagggggagctgtataagaaacgctccgatctgatgaagcctattcaggatgagatttggaatgctatcaaagagattgccaagcgtaacaactatcagatggtgcttgatagaggtacgtccggaattatctttgccagtccgtctattgacattagcgaccttgtactgagcaagatgggctttagcaag

SEQ ID NO: 54 - DNA, 510 bp, Porphyromonas gingivalis
cgaataaataaacaacacgaaatgaagaaattttttctcatgcttctgatggctcttcctttgagcctcttggcacaaaaggtggcagtggtaaacactgaggagatcatttccaaaatgccggaacaagtagctgctaccaaacagctcaacgaattggccgaaaagtatcgccttgatctcaagagtatggacgatgagtttgccaaaaagacagaagaatttgtaaaggaaaaagactctctactggagaacatccgcaatcgtcgtcagcaggaacttcaggatattcaaactcgttatcagcagtcataccaaacgatgcaggaggatttgcaaaagcgccaacaacagctttttgctcctatccaacaaaaggtggctgatgccatcaagaaagtgggtgacgaagaaaactgtgcctacatcatggaggccggtatgatgctttacaccggagctactgctattgacttgaccgcaaaggtaaaagcgaaactcggaatcaag

SEQ ID NO: 55 - DNA, 2484 bp, Porphyromonas gingivalis
atcatgaaggaagctattccccgaaagaacaagtatataaagctcaacggtatatacagattgtcattcattctgctatgctgcctgctatgctctcaggcagctatggcacaaggcgtcagggtatcgggctatgtgctcgaccgtggggaaaagccgatcccgttcgccggagtcaaagtgcgtggtacggggacaggcgcaacgacgaatctgaaaggatactacgagtttcggatgaaggccacgacggacagcatcacgatcgagttcagctccatggggtaccaaggggtaagtcgcagctttccgtctctgaccaaggacactcggctgaatgttcgtttggcagaggccgagatggagctttcgagcgtgacggtacaggccacaaaacgcagactcaacacgatggagcgcgtcaatacccgagaccttcgtgtcaatgcagggcctacgggaggggtggaatcgctcatcagtacctacgcaggagtaacgcagaacaatgaactaagctcgcaatactcggttcgcggaggaagctacgatgagaatatggtctatgtaaacggagtggaggtttatcgcccgctgctggttcgctctgcacagcaggaaggtctgagcttcgtcaatccggatctgacacaatccgtacagttctccgccggagggttcacggccgactatggcgacaagatgtcctccgtactggatattcgctacaagcaaccgcaggagaaggaaggagcggtactcctcgggatgctacaatcgagtgcctactatggcagcagtgccggagccttcagccaaatcacgggtgtacgctacaagagtgccaaatcgctcttgggcactacggacacgaaagccgaatacgatccgatctatgcggacggacagacattcatgacgtaccgtttcagccccaagctgtcggttagtttcctcggcaatatttcgcaaactcgctacaagtttgtccctcagacccgtgagacgagcttcggtacactgagcgatgccaaaaagttgaagatctttttcgacggtcaggaacaagatcgtttcctgacctacttcggtgccttcagcatgaacttcgtgccggacgacaaacagcggcatacggttacgctttcggccttcaacagtaacgaacgggagacctacgatattcagggagaatactttctgaacgatgtgcagctgggggcggacggaactgcttcgatggcttcgggctcagagaactccaacggcttgggcatcgggcgcaatcacgagcatgcgcgcaacaggctgagctaccgcgtgctgaacatgggttacagaggggagatgaagctgaacgagaagcatcgcctgcaagccggcgtatcggcacagatggagaaaatagccgaccatatcagcgaatgggaacggagggattcggtaggatacaacctacctcactcggagaccgtattgctgatgtacaataacctatatgccgatacgcagatgaggggaacgcgcttgtcggcattcgtacaggatcgattcaacttcagcatgggaggaggtacattttctctcattccgggtatcagagcttcgtggtggagcttcaacaaggagttgctcgtcagcccacgtatcagcgtgggttattctcccgaaagcaacccggctttggtactgcgtgcagccgccggactttattatcaggcaccgttttacaaagagctaaggcagacgcataaggatgccgaaggcaataacgtggttgtcctcaacgagaagatccgctctcagggagcttttcacattctcgcaggagcagactataccttcgaaatgggggggcgaaaatacaagtttacggcagaggcttactacaagagcctgttcaacatcaacccgtatataatagagaacgtgaagatccgctatctgggcgaaaacatcggttcgggttatgctgcgggtatcgatctcaagctcttcggcgaactggtacccggagtggattcgtggctgacggcttccattataaaagcccgtcagaaactggatggctacggttctttaccactgatgaacgcacccacttacaatttctccttcttccttcaggagtacgtgccgggcaataaacgcatcacagccaccctgcgggctgcactaagcggaggattgccccagctcaatccgagcaaagggcttagctcgccggcctttaccgcaccggcctataagcgtgtcgatctgggggtaatgtacaaatggctcgacccggatgactcctttgccggccgaagcaaatggctaatgggagtaaaaggggcctacataggggctgacctcttcaatctgttcgacatgaccaacgtcaattcttactactgggtgtcggatgcctaccaacagcaatacgccgtaccgaactacctgacacgccgccaattcaacctgcgtctcctcgtcgaattc

SEQ ID NO: 56 - DNA, 2037 bp, Porphyromonas gingivalis
cctatcccttttcttcttaatatgtacagcggacatcataaaatccattatccttttcttatcctgttggtatgccttgcttttgctgcctgcaagagcgtgaagttgaaagatgcggagaaggcacatgatcgccaagagtataccaaggctgccgatatgtacaatacattatacaggcgtacccgacgaaagcaggtggagatgaaagcttatacggctttccgatccggtgaaaactatcgtgccgccggcagacaagccaaagctttgcgtggctatctgaatgccagacgctacgggtatccggattctgtggtactgctccgtttggcacagacttatcagcaaggaggtaactataaggaagccgaggtactcttccgtggatatctggaagcttatccgaaaagttattttgcagctatcggtttggaggggtgtctctttgcccgccagcaaaaggaatatcctacacgttaccggatacggcgagctgccgagtggaattcggcacggggcgacttcggcccggcctatgcacccgatgcttcggctctctatttcacatcgagcagaagcaaagacgacggtttggataatagcagcataacgggactgaaacccaacgacatttatatcatcaaacgagatgcacaaggacgatggggacgtcccgatagcgtgtccggaggaatcaacactccatgggatgaaggcgtgccaacgatcacgcccgatggtagtaccatatattatacgttggcgcagcaaggagccgattacgaccgtacggtacagatctattccgccgctcggagcggagaaggcggttggagcaacggttcgctcgtggacattatgcgcgattcgctccgtatggctgctcatccctctatgtcggcatccggcgattacctgtatttcgtcagcaatataggcggtagctatggcggcaaggatatttatcgtgtcaaggtgtcggatcgttcttatggttcaccggagaatttggggcctgatatcaatacgccgggggacgaaatgtttcccttcatagatggggatagtacccttttcttcgcttcggacggacacgccggtctgggaggactggatattttcaaagccacgctggactctaccggccaatggcatgtagtcaatatgggacaaccggtcaattcctctgccgatgatttcggcttggctgtggagcctaaaggcaaaaacaaagaagaagctttgccggacaacggagtcaaaggtgtattttgttccaaccgaggcgatgcacgcggatggccgcacctcttccatttcgaactgccggctatctacaccgagattcaaggttatgtgatggacagagaagaaaatcccatagccggagccactgtcaggatcgtaggcgaacgcggccccgtaggacagggattcgtgactactcgtgacgatggctcctataagatgagcgtgcagggcgatactcgctatgtaatgcttgccggagcatcgggttatttgaatcagtacgtagaactcaagaccgataccgccaagcagagtgagacctactatgtggactttttccttgcatcgcgtgagaaagccgagggcttgcaaaatattttctatgatttcgataaagctactcttcgccccgaaagcatgaagagcttggacgaactgattcgtatcctcacggacaatccggatattcggatcgaattgggttcgcatgccgacaggaaaggccccgatgcttacaacctcggactatctgaccgcagagccaaatccgtggtggattacctcacgagtcgtggcatagcggccgacaggcttacgtggaaaggctacggtaagtctgtccccaagacggtgacagccaaaattgccgaacggcacgatttcctgaaggaaggcgatgtgctcaccgaggaattcgtagcacctttgaccgaggagcagcagtcagtctgcgaccaactgaaccgtcgtaccgagttccgtgtgatcgaagaagagttgcgt

SEQ ID NO: 57 - DNA, 2316 bp, Porphyromonas gingivalis
cctgcacagccgaaaacatattgcatacgatactttcggagagaggtatctccgaggaggcaaacagaaaggacattgtatgcggacaagatgcgccggcatatcgtcaagtgctgtccctctgcctccatactcttgcaagaatactccacaacagaattattcattcatcactttaacatatcaataattatgaaaaagtttttcttcgcgctactatcgattggtatttcagcgcaggcttttgccaagacggacaacgtcccgacagattcgctacgagtacacaatcttcagaccgtcacggtctattctacacgcacggccgtacctctgaaaaagataccggccaagatggaactcatctcatcgcgcaacatcaagcagtccggctttaacaacatgaccgacatcctcaagacgcaaagttcgctcgatgtcatacaatacccgggctttagttcgaacatcggtatccgcggtttcaagccctccggcaagtatgtaaccgtattggtaaacggcatccctgcgggaacggacaatatctctacgctcaacacgagcaacatcgaacaaatcgagatcctcaaaggcccgttctcttccatctacggcaccaatgccatgggcggtgtggtgaacatcatcacccacaaatccaaggacaagatccatggcaacgtttctctcttcggcggtagctaccagaccatggccggatcattcaacttgggtggccgcttcgaggatattttctcattcgatcttagtctgggcttggacaagcagaacaaggactataagaccggatcaaacaatttcctatccctgagcaaactggaagaagctatagtagatgtaaatgctaccaaaaacaagaaaatgaaggggagcgactatactgtagcaacgggacgtctgcgtttcggtatcgacttcacgcccgaatggtcgctgaatctgtatcaaaacgtattcctcggagatgcgatccccgtaggaggatctatatggggcgtttacggagaatccaaaaaaaatctgaatcgttcttcgacctctttcgagctgctcggcaaacatggctgccacacgcttcaattctccccctacttcaacatagagaaatcggagaactataacaatgccgatcccaccggtttcatcaactacaaaagcgactactacacctatggtgccctactccaggacaagatttcctttggaggacaaaatatcgtactcggtgtcgacagccgaaacatgacgatggagtcagaaagattcgagcaggcaggagtgaatacaaagccatacaaccccggatatgccacgaacaatatcggtttgttcggacaggccaatttctacctgctgaacgatgctctatcgatatctgccggtgcacgtgccgacttcatgttctttgacctgaaagcgaacgagtatctcaacaatgaagccaaacaggaaactcataacgtaatcaatccgaatgtcggaatcaaatatgagtttgtgaaaggccttacagctcatggtacattcggtagtgcattcagtgctcccgatgctttccaaaaagcaggccaatacgtaggcccgttcggcacgaccataggcaatcctgacctgaaacccgaaaagtccatgacctgggacttcggtatcggatacagcaatgcacgctgcgggatccaagccgacgtaaccttaacctatttccacaccgaccacaaagatctgatcttgtccagccctgactatgctaataatatcaccacatacatcaatgccgacaaggctcgtatgagcggtatcgaggcccttttgtcttatgacttcggcagcctctttgccaacaagttctctctccgcgcatttgcgaatgccacgatcatgctcaattccgagatgaagaaaagccagaccgatgccccttggagcgaaatgtactacgttcgcaagcagaacatcaccttcggtatcgaatatcgtggcaaagaaggacttgaagtgatgctcaacggtcgcttcatgggacgcaggatcgagcaaaactggtatgcttactaccccgaagttcgccccgaactccagcaactgcttgcagcagaagagcctgaattggctgctcagggactgctccgtcatccgcaagcaatggtgttcaatgcctctgcttactaccacatgaacaagtatctcaccttcggtgtgaacttgaacaacatcttggatgagctttatacggagaaagacggctaccacatgcccggacgtaacatcatgggtaaggttatggtcaacttc

SEQ ID NO: 58 - DNA, 1452 bp, Porphyromonas gingivalis
ggccgggcctcttccccttacaggcaaatggatggcatactaaacgatgaatatagacaagcatctatgaacaggttttcaaatcattggccctgcatcctcgtggggtttgtactctggtttgtatcggcgagtcggactgtggcacaaaacgcctccgaaacgacggtatcgtacgatacggataccgccgtactctccgaagccgatgtgcttcggatcgctcttagtgagaatgccacagtgaaagtggccgatatggatgtgcgcaaacaggaatatgcacgtagggcagcacgtgccgatctcttcccgaaagtagacctcaatggcgtttacagccatacgctaaagaagcaggtcttatatatagatatgcccggtttcagcagtagcgaaggtatcgaaatggggcgtacacacaatacgcaaggaggggtgaacgtctccatgccattggtgtcggcacagctttggaaaagcattgccatgaccggagaacagctcgatctggctctggagaaagctcgcagctcccgaatcgatttggtggcagaggtgaagaaggcttacctcagtgtattgttggccgaggactcttatggcgtattcaagcgcagctatgacaatgctctggccaattataagaacatatccgacaagttcgatcgtggacttgtggccgagtatgataagattcgagccaatgtacaggtacgcaacatcgagcctaacctcttgcaagcgcagaactccgtagcccttgctctctggcagctcaaggtcctgatgagcatggaagtggaaactccgatcagactctccggttcattgtccgactataaagaacaagtctataccggctattttgccgccgatacgcttatttccaacaactcctccctgcgtcagctcgatatacagcgtcgtctggctgtcagtgcagacaagctgaacaagtacagcttcctgcctacactcaatctgggagggcagtacacctattcgctcaacagcaacgacatcaaattctggggcgagggacaacgctggacgcctttctccaccatatcgctcagcctgtacattcctatattcaatggaggcaaacgtctgtacaacgtgaagcaaagtgctttatcgatccgtcagatcgatctgcaacgacgccacatagagcaatccatccgaatgggaatcaagaaccaaaatgaccgtctgcgtacctgtatgcagagatttgtggcctcggaagaggctgtccgaagtgcagaaaagggctatcagatagcagagaaacgctatcagacaggcgaaggcactctcgtcgagctcaacgatgccgatgtggctcttttgcaggctcgactcaattataatcaggccatattcgactttatgaccgcaaaggccgaattggacaagatgaacggcatggggattcccgaacaa

SEQ ID NO: 59 - DNA, 1620 bp, Porphyromonas gingivalis
tttcataactttgacttcctaaacggtataaaattgttttcgatggcaaataatactcttttggcgaagactcgacgttatgtctgccttgtcggtttctgttggctcatggcgatgatgcacctctctgggcaggaagtcactatgtggggggacagccatggagtggcgccgaaccaagtgcgccgaacgctggtgaaggtagccttaagtgaatcccttcctccgggtgcaaaacagattcgtatcggattctctcttccgaaagaaacggaggaaaaagtcaccgccctatatctccttgtgagtgattctttagcggtgcgcgacttgccggactacaaagggcgagtctcttacgatagcttcccgatctcaaaggaagatcgtaccacagccctttctgcggattcggtagccggacgccgcttcttttatttggctgcggatatagggcctgttgcttctttttcccgatccgatacgctgactgcccgtgtggaagaggtggctgtcgatggccgccctttgccgttgaaagagctgtcgcctgcctcccgtcgtctgtatagggggtatgaggccctctttgtacccggtgatggcggatcgcggaactatcgtatcccggccattttgaaaacggctaatggaacactcatagcgatggccgacagacgaaaatataatcagacggatctgccggaggatatagatatagtcatgcggcgcagtacggacggagggaaatcgtggagcgatcccaggattatcgtacagggagaggggcgcaatcatggctttggcgatgtagccctggtgcaaacccaagcaggaaagctcctgatgatctttgtcggtggagtaggcctgtggcagtctacccccgatcgtcctcagcgcacttatatatcggaaagtcgggacgaaggactgacttggtcgcctcctcgggatataacccatttcatcttcggcaaggattgtgccgatccgggacgcagtcgctggttggcctccttttgtgcttcgggacaagggcttgtgctgccatccggtcgtatcacgtttgtggctgccatccgcgaatcagggcaggagtacgtcctgaacaactatgtcctctatagcgacgatgagggcgatacatggcagctttccgactgtgcataccgccgtggcgatgaggcaaagctttcattgatgcccgatggcagggtactgatgagcatacgcaatcagggacggcaggagagccgacagcgtttcttcgctctctcctccgacgatggccttacttgggagagagccaagcagttcgagggcatccatgaccccggctgtaatggagctatgcttcaagtgaaaaggaacggaagggatcaagtgctgcactccctgcctctcggcccggatgggcgtcgcgatggagctgtctatctcttcgatcatgtctccggccgctggtccgctcccgttgttgtcaattcaggatcgagtgcctactcggatatgactctgctggcggatggaacgatcggttatttcgtcgaagagggcgatgagatctcattggttttcattcggttcgtccttgacgatctcttcgatgtccggcaa

SEQ ID NO: 60 - DNA, 879 bp, Porphyromonas gingivalis
aagtctccgagcgattcggctttgccgtcggtatggagcgcgaatacaatatctggactcgtcggtgggaaacgcattactttgcttatcctgtattctatggcgataagaagtagtaatatagaatcaatacagtgctttgtgatgaaaaaagaaaaactttggattgcgatcgtcgccggtttggctttcgtattgggcctttatgctcttggccgcagtgtcgctcagctacgccgctctcagccttcggtgactgtgaccggtatggccgagcgtaatttcaaatccgatctgatcgtttggactgcttcgtaccagctccagatgatggatctcgaatcggcctacaaggctttgaaggaaaaacagatattggtagcagactatttgaaaaacaagcagctgcccgattcgtcttatatcttctcaagcgtagccatctctaaagaatacaactactattacgatcctcggcaggaacaaaacgtcaggacctttgccgggtatctgctcagccagacagttacggtgacctcacaggacatcgaacatgtggagaaaatatctcgcgatataacggagctgatcaatcagggggtagagattacctccgaccgtccggcctattactacaccaagctcaatgatctgaaggtggagatgctgcgcaatgcctccgaagacgctttcaatcgtgcttcggtcattgcggaggggagcggttcctccgtgggtaagatgctatcttcttcgatgggcgtgttccagatagtggggctcaactcgaacgaagattatagctggggaggttcgttcaatacgtcttccaagatgaagacggcaagcataacggttaaggcttctttcgctttgaag

SEQ ID NO: 61 - DNA, 840 bp, Porphyromonas gingivalis
gggaaactccaaatgaaaaaaacaattgcaattatcgcctcagccctcttggctttaggagccgtcggctgtaagaaaaatgctgacactaccgctgtcagtgaaaaggatagcatagccttgtccatgggtattttgtacggacaggattttgccaatcagttcgaaatgtcccgcttgcaaggccagccgattgattcggtagctttcttggacggtttcaaatatggtatcgatacgacgcgcttctcgtacaatctgggagccatctatgcttccaatatagctcgtcagctggctcatgattccatcgatatcgacaagttctatgcagccatgcgtgcggctcttcttaaagacaccgtatctatcgccatgaagcctgcagatgcacaggctttcatgcaacgaatccaagccaaaaagcagcgagaaaacaatatgaagcagtttggccagaacatcgaaaagggtaatgaatacatcgatacctttaaaaaagaagatggtgtaactgttacgacaactggtctggcatacaagactcttcaggaaggtacgggagctactccctctttggccgatactgtacgtgtcaagtatgtgggtactctggtcgatggtaaagagttcgacaaaaacgaagaaggaatcgaatttgccgttaccggtgtgattaaaggctggacggagatgctccaactcatgaaggtcggtcagaaagttcgcgtggtaatcccacaggagctggcttatggggagaccggcaactataccatcgaaccgttctctaccctgacgttcgagatggaacttatcgggatcaagcccgggaaaaag

SEQ ID NO: 62 - DNA, 2409 bp, Porphyromonas gingivalis
tgtcgaaagcagaagctctcaaacccgaagaggagccggtatccgtgcagacggatatcattccgacaaagcgataagaatccgatgaaagtattacggcaagtattcctccccatcctttttgtcctactgacaggtgcctgctccaccacaaagaatctgccggaaggcgaacagctgtatatcggaatgggcaagacacagatactccggcaggacaagagccacgccggccaacaggctctgaccgaagtggagagtacactgaaagttacacccaatggagctattttcggcagtgcaagtgcctccttacccaagataccattcgggctatggctatacaacagcttcgtgggggattccactgtcatttcgaaatggatattcgacaagtttgcagccaagccggttttcatcagtcaggtcaaatccgatagccgggctaaggtggcgacgaacatcctccgcgaacacgggtacttcgatgctaaagtaaaaagcagtgtgaccactctgaaaaaggactcgctcaaagccaaaatctcctatacggtggatatggcctctccttatcattacgacagcatcattcccttaccgatcagcactttccccgacagcattctggcttacaggcagactccgtctttgatcaggaaaggagaccagttcaatttggcaaagctgcacgaagagcgtcagaccatcagtgccctgctgagagacaatggttactactacttccgcccacaggatattatctacgaagccgataccctcctcgtaagaggtgccgtatgcctgcgagccaagctctcggaagatactccaccccaagccatgcgcccgtggaggatagggaaacggacagcagtcctgctcggaatgaacggagaaagcccgacagactcgctcgaagtggaggatatgaaagtcctttactatcgtaaaatgccggttcgccccaagattttggccaaacgctttcgtttcttctccggcaatctgtatcggcagaaagacgatgagacgacacgcaaatccttggctcgtttgggagccttctccgttatcgatctcaattttttgcaacgcgattccatttccggccttttggatgtgcgactgctaaccaccctcgacaaaccttgggatgcatcattagagaccttgttcacgagcaaaagcaatgacttcatcggtcccggactgaattttgctcttgctcggcgcaatgtattcggcggaggagaaaatctttcttggaatatcggtggatcgtatgagtgggagaccggcaatcgtcccgaaaatagcagcaatcggctgatcgatataaattcgtacaacatgaatacggccgtgaacctctcgtttccctcgattgtatttcccggtctgctggataaatactattactaccccacgactacgacttttcaggcttctgccaccgcgctgaacagggcacactactttagcatgtactctttcggcttttcgaccacctacgaatttcagccctccaaggaacaccggcatgctattttcccgctcaagctcaactacaacctcctggggcatcagacagaaactttccaggccattacggcgaacaatccgcccctgctgctcagccttcagagtcagttccttgctcaaatggggtatatctatacgttcaacaaatccgtttcagagaaaagtcctcatcatctttggatgcaattcggactatccgaggcaggcaatctcctgaatctgatctatctggcagccggcaagaagtacagcgacaccaagaatttcgtcggcgtccccttctctcagttcatcaaagccacgggagaactgcgctattcctataccatagaccgcaatcagtcactggcaacccgtttcgggacaggcgtgatatatagctatggcaatatgcgagtggcaccctatagcgagcagttctatgtaggcggtgccaatagtatcagagctttcaccgtccgtagcatcggccccggacggttcaatccggattccgacaatcagtattcctatttggatcaggtgggcgaattcaaactcgaagccaacgtggaatatagaggcaagcttttcggggatctccacgcagccgttttcctcgatgcgggcaacgtttggctcttgagggaggattcttcccgtccgggcggtgctctgtccgaagtgggatcggtgagcaatttcctgaatagcatcgctctcggcaccggtgtcggccttcgctacgatctggcatttctcgtggttcgtgtcgatgtcggcttcggtctccaccttccttacaatacgggtaagaaaggttactacaatatcccacgctttaaggatgccatcggtttccatttggctgtcggctatcccttc

SEQ ID NO: 63 - DNA, 2349 bp, Porphyromonas gingivalis
tctctctccccgtatatccgttttcctatgtcctcgcattccgttcggtatctaatcggcattgccggctgcttgctcctcatgcttgcttcctcctgctcggtcacccgttatgtgccggacggtagcagactattagacagggtaacgatcgcaagcgaaacgggcagtatcgctctgccggaagatattcgggactataccctccagcaacccaattacagactgttcgggatgactcgctggctactgcgcgtctatagcagctcgaatccgaacagcaacagctggtggaaccgttcgctccggaaaatgggcgaaccgcctgtcctcatcgattctgtcctcaccgatcgtactgccaaccgtctggcaaaggcgatggccggcgatggctttctcgatgctactgctcgtgccgtggtagacaccggcttgtacaagaaagctcgcattacttatctgattcagcccggaagccgttattatatacgcaatatggctttggatgtgaagaatccactccttcctcccgttgcgcttggcaattcgcttccttcggcatacaaggtcgggatcagcgagggttctcccttgtcgcccatcgtactcgatgaagagagaaaggcgatagctcgtcatatgcgcaacaacggcttctggaagttctccgccgaggatgtttattatgaagcagatactaccgtttcaggaggatcgggtacgaaatctgccgatctgaaattagtggtcaatggcatcgggcgttatccatatcggatcggcagggtattctttcatgccgattatgatcctctcgaatcggacttcagagttcaggagctgccacgtatcgattcgatttcgcgtggcgattacactgtttactatgggagtaggggacgttatatccgggcatcggctctcacgcggtcggtgtccgttacaccgggagcttttttctgcgaggatgatgtggaacgctcttatatcaagctgaatgcgctccctatcgttcggaacgtgaatatccgatttgtggagcacaatggtaaggatgagattgctctggcggatagctctcgccttgtggactgctatattcttaccgttccggccaagagcaaatcgttcgaagccgaagtcctcggcaccaattccgctggagacttcggggcggctttgtctctcggtttcaccgatcgcaatttgtttcgtggggcggagatgttcaatatcaaactcaagggtgcttacgaagccattcgcaagggttcgcacagcttcatggaatatggggtggaaagctcgctccgtttccctcgtctcctcttcccattcatttctgacgaaacgcgccggcggctacgggcatccacggaatggaagatcgggtataattaccagacacgtccggagtttgatcgggtgattctctccgctcaactcaattattcatggcagacctacctgcacaatcgtctgcgtcatacgatccgcctgctggatgtcgattatctccatctcccgtacatcgatcccgacttcgcccaatcccttccgcctacgactgcactgtataactacacggagcagtttatcctcggctcggcatatatactgaactataccacggcttcgtccatggagcgtaccgtatccaatccttttacggcacggttcagtatccagacagccggcaacctgctgcaagccatttcttatctgaccgattctccgaaagacgaacacgggttgtataaaatgttcggtctgcactatgctcagttcgtcaagctcgatctcgatctggctaaaaccgttcttctcgaaaaggacaatactttggcactgcatctgggtttcggactggctttcccttatggcaatgctcgccatataccctttgagttacgttactttgccggaggatcgaacagcgttcgcggctggagtgtccgtaccctcggcccggggagtatgaagatgactccggacaagaccttcttcgatcagatgggtgatattcgtctggatctgaatgtcgaatacaggacaaagctgttctggaagtttcgcgcagcagcttttgtcgatgccggcaatgtctggacgataaaggagtatgagaatcaggaggacggtctctttcgtttcgatcgcttctacaaggaaatagctttggcctacggtctggggcttcgtctcgacttcgattatttccttgtgcggctggatgccggactgaaagcctacgatcctcagcagacagggcgttacaaatgggctatcacacgcccaaacctttcttccaatttcgcttggcacattgcagtaggctatccgttc

SEQ ID NO: 64 - DNA, 2625 bp, Porphyromonas gingivalis
  modified_base (1174)..(1174): n is a, c, g, or t
gtcgaatctaaattgttatgtcttatgagaaaaagaattctacaacttttcctgaccgcattgctgctggcattaggctcctctctcgccatagcgcaaacagtggtgaccggtaaggtgatcgattcagaaacgtccgaaccgctcatcggtgtatccgtaagcaccggtcagggagcatccctccgcggtgtaaccaccgatatggatggtggcttccgattcgaagtaccggccaaatctgtcttgactttccgttgcgtaggttatgctaccgtaactcgctctataggcagaggttctcaagaagacctcggtacgattctcctcgatccccaggccatcggcttggatgagattcaggtaatagcctctgtggtgcccaaagaccgtatgacgccggtacccgtttccaatatccgtgtggctgatattcaggcagcatcgttgaatgtcgaatttcccgaactggttaaatccactccctctacctatacgacaaaaggaagcggaggtttcggtgatggtcgtaccaatgtgcgtggattcgacacttacaacttcggtgtactcatcaacggagttcctgtcaatggtatggaagacgggaaagtatattggagcaattggagtggtctgatgaatcaagccagtaccattcagattcagcgcggactcggagcctccaagctcggtatcagctcggtaggtggtacgatgaacattatcacgaagactacggacgccaacaccggaggttcggcttatgtcggtatgggtaatgatggattgcacaaagaatcgttctccatttctacgggtatgaacgacggttgggctatcaccattgcaggctcccatatgacgggtctgggttatgtgaaggggctgaagggacgtgcattctcttacttcttcaacgtttcgaagaagttcaatgaacgtcataccctctctcttaccggattcggtgcaccacaatggcacaaccaacgttcttccaaatattctgtagccgactatgacaaatacggcatccgtcacaatcaatccttcggctatctgcgaggcgaactgactcctacggcttatgcttacaatacgtaccacaagccccagttctcgctgaaccacttctggaagatggatgaaaatacctctctttataccgcancctacgcatctttggctaccggtggaggtcgtcgcgcttatggaaagaacagtaagtgggtattgatcaactacaacaccggacaaccctatgaacaaacaaaggtgactcccgatggacttatcgactacgatgccgtactggctgccaatgctgcggcgagcaatggctcggaagcaatttttgcccttggctccaactctcacaagtggttcggtctactctcttcattcaagaagaaacttaatagttcgctgactttgacagccggatacgatgggcgttactaccgtggcgaccactatgacaagatcaccgatctgctcggcggtagctactacatagaggatcccaagacaaagctcgcataccatgcggaaggtcagcaactgaaagtgggtgacattgtaaatcgggactacacaggcgaaatcatgtggcacggcctcttcgcacagatggagcattcgtccgaatggatcgatgcattcgtatcaggatctatcaactacgaactataccgcaatcacaactatggcggtagcaagtccaccggctacctgcccggcgtatcgccgtggaaaagcttccttccgtggagtggcaaggcaggtctgagctacaagttcgcacagggacacaatgtattcgccaatggcggtttcttcacacgtgcaccactctttggcaatatctatgctgcgggggctatcattcccaatgacaaagccaatatggaaaaggtgcttacaggagaggtcggctatggattcacgaatcacaaaaacttcgagttcaatatcaacggatactatacgaagtggatggatcgcgtgacctcgaagagaatcggaaacgagtatgtttatctcaatggcgttgatgctgttcactgtggggtagaggctgaggtcagctatcgtcctattcgtcagatcgaccttcgcggtatgttctctctcggtgactggacttggcaaaacaatgtaagttacacttcttacgacgaagccggcaatgagacagggcaggatataacctatatcaagggtcttcacgtcggagatgcagcacagatgacggctgctgtatcggcagacatagagctgttcaagggtttccatgtcataggtaagtacaacttccttggcaagaactatgcaggattcaaccccgcaacgcgtaatgcacagcagtacgaagcggatggcaaagaaatcgtggaatcatggaagttgcccgatgtaggtctgttcgatctgtctgcatcctacaatttcaagcttggttcactcagcaccacattctatttcaacatggacaacgtagccgacaagcgatatgtgagcgatgccgacgacaatatcatcggtaagaaacacgatgaggcttcggctctcgtatggtacggtttcggccgcacttggtctaccggtattcgtgtaaacttc

SEQ ID NO: 65 - DNA, 1380 bp, Porphyromonas gingivalis
aacagatgtaatccctcgcgtcaatacttccacctatcgcagaatgacgttggaagatctctccgagcttttctaatccatctatctatgaagttttcaatccgccttttcctctgcatcatctttctcctctctgcatttatcctgcctgctctcggacaaaaatccaagcaggtacagcgacttgagaagcaacgtaaggaggccctcaaagccatcgaaaaaaccgatcgcgaactacgaaataccaagaaagacaagcaagacaaacaaaagcatctcaacctcctgaacaagcaggttgctcaacgcaagcagatggtacaactcttggacaatgaggtcaaagagttgcaatccgacattgattccatgacgggtgtatgtcatcagctctctgtagaagagaaagcccgatccgatgaatatgcccaagctctacagtctatgcaaaagcggaaacgctcgttggatcgcatccttttcatttcatcggccaagagctttgacgaaggcatgcgacggatgcgtttcttggaacaatacgcttctgcatacaagctggcatctgtccggctgcgcgatacacgtagcaagttggagactgaacgtgcgactgtagaagacgccaaaaaggagaaaggacatctcttagtcatcagagaagaggaaaaaaagaaactcgaaggacagcaagccgagcaacgtcggcaggtgcaggctttgggagccaaacaaaaagacttggaagcgcagctgcgaaagcagaaaaagcaagccgaagctctgaacagaaagatcgagaaacagattgccaaggaaatagaagctgccgaacgtcgtgctcgagaagaacgtgaacggttggcacgcgaagccaaagccaagggtaagccggttcctgccgaaccggaacggaaggcggagaccaaaggcggctatgctatggatgcctctgagcgtgctctctcgggcagctttgcacagaacaaaggtcgcctgcccggccccgttcgcggcagataccgaatcgtaagcgactttggcgtgcatcagcacagtgagctgaaaaaagtacaagttaataatggaggtatcgacatcgctgtagcaacaggatccgatgctaccagcgtattcgatggtgtagtgtccagtgtattcgtgatacccggttataattcggccgtaatggttcgtcacggtaactatatcacggtttatgcgaatctgagcaaagtgtatgtaaattccggcactcgtgttaaaacgggtcaggctcttggtcgtgcctatacggatccttccaacaaccagaccattattcacttcgaaatctggaaagaacgcagcaaacaaaacccaagactatggttacga

SEQ ID NO: 66 - DNA, 1026 bp, Porphyromonas gingivalis
agtttttatcaagaaatagacagacttatgaaaaagtatttgttatatgcctcgttgctaacgagtgttttgctcttttcctgttcaaagaacaatcctaacgagccggtggaagacagatccatcgaaatttctataagggtagatgatttcaccaaaacgggtgaggcagtacgctatgaaaggaatcaaggaagtgctgccgaaaggctcattaccaatctttacctcttgttgttcgatcagtcaggggcgaatccggcgaaatactatattaccggtaacactttcaccggagggacctggcttcctgacgatatgaaggtgaagttggatatgacacaatccgaggccggagagcgcaaagtatatgtcgtagccaatgttgataatgcggttaaaacggctcttgatgctgtcgctaacgaaagcgatttgcagactgtaaagaggacgactgcaatgccgtggtcgaccgatatagcctctcctttcctgatgtccggaaacaagacacacgacttcttggccaatcgtcttttggacaatgtgccccttgtgcgtgccattgccaaggtggagctgaatatctcgctgagtgagaaatttcagattgtgccgataattgtcaatggtagtttgagtgagttcaagttcagatacgtaaacttcgacaaggagacctacgtagtgaagccaacgaccaagccggacaatctcattagttctgctaatggtgtttggcctcagattacagattggactgtatggggtgcttccttaaatacttctcctgctccggatgcgggcacaggttatacattggatgcaaatggcaaggtaacggcactacggattgttacctatctgaatgagcgcgatagcaaaggggctacggtagaggtcgcattgcctcgtgtggatgatggcacccttcctcctccggaattcggtccggagctttatcgtttgcctttgccggacaagatcctgcgcaatcattggtacaagtatgaagtcgagatt

SEQ ID NO: 67 - DNA, 987 bp, Porphyromonas gingivalis
aaccttaggacacagcctttctttttggtagatttgcaatctatgatcagaacgatactttcacgatatgtatcctcgaacttttggagtcggggagctaccttttttttcacgattttcccggccttcatcctcgccgctactgctttgccggcttgtggagggggtactgcttcaggctccgatcgtacgctggctgtgaccatcgagccacagaaatacttcatcgagtccattgcggataagtcggtgcaggtggtggcattggtaccggccggcagcaatccggaggaatacgacccttcgcctaccgtgatgaagcgtttgtccgaagcagatgcctacttctatataggaggactggggttcgagcaaagaaatctcgctgccattcgggacaataaccctaagctccctcttttcgaaatgggcaaagccttggcggatgccggaagtgcagatctccacggctcctgcacagatcattctcatacagacctgcatgcccatgatccgcactattggagcagtgtggtaggggcaaaggcactcagtcgtgctgcatacgacgcgcttgtggagctttatccgaacgagaaagacaaatgggacaaagggcacgaccgtctcaacggacgtatcgacagcgtgaagagactcgtcgataccatgtttgccaatggcaaagcagacaaagccttcgtcatatatcacccatcgctcagctttttcgcccaagagttcggcctgcggcagatcgtcatagaggaagatgggaaagagcctacggctgcccaccttcgtcgtgtgatcgatcaggcacgtgccgatggtgtcagaatcgtatttatccaacccgaatttgaaacgcgtcaggcggaggacatcgcacgcgagatcggtgctcgtccggtaaggatcaatcctctgcgcagctcgtgggaggaggaaattttacatattgctcgcgctttggctcatgaacgg

SEQ ID NO: 68 - DNA, 2634 bp, Porphyromonas gingivalis
gcagattctattcgatatcctctttacttttttgggcggaatcggaagaaatgctttagggaacctattcccaccttatacaataaaaacatgatcggaaaaaaaatcttttttatcctgctggcgctcattgcgttcagtgggctgaacgcagcgacagacactgagttcaagtacccgaccgatgccaatatcatcggtcacgtcaaagacagcaagacgggtgaacaccttgtcggtatcactattgctatcaaaggcactacctttggtacatctacagatgcaaccgggcactactatcttcgtaacttgcgtccgggtgagatcactttgattatgcgtggcatgggctataagagccaggagcgcgtagtccgcgtagaaaaggacaagactatcgaggtgaatttcgaagcagaagaggatgccatcaatctggacgaagtcgtgatttcggccaaccgcgaactgacgcttcgccgtcttgctcctactctggtaaatgtattgaacgaaaaagtcttctcgcaagtcaatgcttctaacctggctcaaggcttgtcattccagccgggagttcgtgtagagaacaactgtcagaactgtggtttcaatcaagttcgtatcaatggactggatggtcgttatgcacagatcctcatcgacagccgtcccatcatgagtgcccttgccggtgtttacggtctggagcagatccctgccaatatgatcgaacgtgtggaggtagtacgtggtggaggatcggccttgtacggttcttctgctattgccggagtggtgaatatcatcaccaaggaaccttctcacaattctttcacattcaatgaatctctgagctttaccggtttcagcaagctggataacaacacgaacttcaatgcctccatcgtcagcgatgacaaccgtgccggtgccatggtattcgggcaggctcgttaccgcaaccattgggatgctaacaatgacggttattccgaattgggtaaaatagatgcccgctcgctgggagcgcattcttatttgcgcttgagcgactacagcaaattgacgggagagtttcacacgatcagtgaattccgccgtggtggcgatcgtatcgatttgcctcctcacgtagtgggtgtagctgaacaaactgaccatagcgtatttagcggaaacttgaaatacgatctcttctcttccaactataaacaccacttccaggcttatacttccggacagatcgtaaatcgcaagagctattacggaggtatcggagagattgacgtcaatggccaccccggtggtacggaaggctaccctatccctcaagatcaatacggcaataattatggcgtgaccaaaggcaagacatatatgggcggtatccagtacagctacgacttggacaaattcctcctcatgccttcgcaacttttgttcggagccgaatatacgcgtgatgaactcaatgacgtgatgcccatcctttcatggcagaccggcgaggatgccaatgggaataccattcccctctatcccgaattggatcagaatatcaacaactacagcctattcggtcagaacgaatggaaaaatgacagatggagcatccttgttggcgctcgcttggacaagcatagcgaagtcaaggatatgattctgagtcctcgtaccacactgcgtttcaacgtgaatccggacatcaacctgcgcgctacatatgcaaaagggttccgcgcaccgcaggtattcgatgaagacttgcacgtaggggttgtaggcggtgaggcacagaaagtattcaacgatccgaacctcaagcctgaaatttctcatgcattcagtttgagtgccgatatgtatcatcgtttcggtaacgtccagaccaacttccttgtggaaggcttctatactcgtttgctggatgtattcaccaacgaggagcagcctgatcagcacgatggcatcaaacgctacacgcgtatcaacggtagcggagccaaagtattcggtctcaatctggaaggtaaggtcgcatacaagtccttccagctccaagccggtcttaccctggccagcaacaaatacgacgaagcacaggagtggggtctgaatacggtgaaagacaccaacggagcttttgttaccgaggccaatgcaaatggacaacaggaatacaagaacgaatccatgacggatacgcagatcacccgtacccccagcgtatacggttattttactttggcctacaatcctgctcactcatggaacatagcccttacgggagcatataccggtcagatgtatgtaccccacgctatcgaatatggtgtgaagtctgccgaactggatattatgcagaacaatcctgagattaccgacgaaaccggaaaggctccccgtattgatgagctgaagaagacacctgcattcttcgatttgggcttgaaagtgggttatgacttccacgtattccaggctactgaggttcaactctatgtaggtatgaacaatatcttcaactctttccagaaggacttcgatcgtggagctgcacgtgacagcggatatatctatggtcctacgcagccgcgtacaggctacatgggcttggtagtgaagttc

SEQ ID NO: 69 - DNA, 618 bp, Porphyromonas gingivalis
aaacagatagttatgacagtaaagcgcgcagtgcgaatagcacttctcacgctgataggcattcttttttcctcaccttctcttgttcgggcgcaaagtcttttcagcaccgaacatgtcttgcaactatacaacaagatactctatggagagtcggcggcggataccgtcgcagagaaaacggcaggtgagtcggcatttccttttatagacaaactcatcaatctcggccgcactttcctcggcaaaccatatcgctatcgcggtccttccccatggccgatggactgctcgggctatgtgtcttacctctactccaaattcgacatcaaactcccacgtggtgcggcagcacagagccaatatacgaatcctatcgagcgcgaggatgttcgtccgggcgacctcctttttttcaaaggccgcaatgcacgcagcaaccgtatcgggcatgtagctttggtcgtatctgtcgatgaagatgatattaccatgatgcacagccgcaattcgcgagggatcgtgatcgaaaaactcaatcgcagtgcatacttctcccgtcgcttggtgagctatggcagggtacccggagccaagagagtgatcccacgaaaaagt

SEQ ID NO: 70 - DNA, 1401 bp, Porphyromonas gingivalis
aaaggtacgtggaatagaaaaaaccgaagagaagaaatgaaacggacaatcctcctgacggcactgaccgtcctatcttcgctctccttgcttcgtgcacaaaatgaatccgaagcatcaaccaatccgatgtcaggcctctccctggaagactgtatccggatagccaaggagcgcaacctgaatctgcgcagacaggagatcgaacaagaaaaccgaatcattagtctcgatgcagcacgacacagtttcctgccctcggtcaatgcaggcatcggacacaactatagcttcggacgttcgaaagacaaaacgggagtaaccgtagatcgctcctcgatgaataccaatctcagcatcggagcttcggtggaagtattcagcggcacacgtcgtctgcacgacctcaagcagcaaaagtacaacgtggaggatggtatagcccgacttcaaaaagcgcgtgaagacctcagcctgcaaatcgcggctctctatatcaatttgctcttccgtcaggaaatgactcgtacggcagaaacacagttggcactgattcgcgagcaacgcaatcgcacggccgaaatggttcgcgtaggtaaatgggcagagggtaagctcctcgacataaatgcccagatggccaaggacgaacaacttctcgtacaatatcgttcggaggaggagctggctcgtctggacttggggcaagccctcgaactggagcaccccgaaagcattgcagtcaaggctcccgacacagacgttctcgtagcagaaaggttgggatctctccttgctcccgaagagatctatcgcacggctctcggcttgaaaccggcactgcattcgagcgagctgcaaatagcttcggcacgcgaaggtctggcctcggctcgtgcggcatacttcccgacgctcagcctctctgccggatacagcaacggttacttccgcgacctcggcaaggagtatgccgccatcaacccctccttctccgaacagtggaagaacaacggcagctacagtatcggactctctttgaatatccccatcttctctgccatgcaaacgcaagatcgcgttcggagcagtcgcctgcaaatacgctcaagcgagcttcgactcgtcgaagagaaaaaagccctctataaagagatcaggcaagcatacagcaatgccgtggcagccgataaggccatcgcagcagccgaaaacagcaaggccgctacgctcaaggcatacgaatacgctcgcgacagcttcgaggcagggcgcttgtctgcctacgaatatgccgaggcaaaaacaaaatacgccctcagccaagtggaagaacttcgtgccaagtatgacttcatatacaaagccaaagttttggatttctatcagggcaaagacttc

SEQ ID NO: 71 - DNA, 1353 bp, Porphyromonas gingivalis
aaaacatcatatcggaataatatgcgtttccaacattatctcatctgtacggctgccgtagcggctttggctgcgaatccccttacgggccaatcgaatatgaccctcgaagagtgcatagactatgcacgccggcacagttcggccgtggcgctgtccgctgcggaactggagcagtccaaggccgattaccttcaggccgtcggcaattttctgccccgtgtatcggccggaaccggtgcttcgtggaatttcggacgcggattggatgccgagacgaatacctacaccgacatcaacagcttcaacaattcgtacagcatacatgccacgatgacccttttcgacggtttgcagagtgtctatcgactgcggatggcgcatgcacgccgggaggcttcgcgcctctccgttcgcgagcagcaggagctggcagctctcggcaccacggaggcctactacgacctcgtctatgcgcgccaaatgcaagagctggccatgcagaagtacgaggagagcagccgcctccaccggcagacggctcgaatggaagagctggggatgaagagtcgtcccgatgtcctcgagatgcagtcgcgaatggccggtgaccgtttggccctgactcaagcggacaatcagtgcatcatcgctctgatccggctcaaagaaaaaatgaacttccccatcgatgacgaactcgtcgtagacgatatgccggctgacagtctctccgccgacatggccgaatcggacagctcggccggcgtcttcgcccgtgctgcccatcatcatcccgtcctcctccgtgccaaactcgacgagcaggctgccaccgaccgtttgcgagccgcgcgaggtgcattcctgccgagtgtgtcggtatccggaggatggaacacgggattctcacgctttttgaatggatcggactatacgcccttcagcgagcagtttcggaaccgtcggggggaatacgtcagtctgaatctgagtatccccatcttttcgggattcagccttgtgagccatctgcgtcaggcgcgtgccgaacgcagggcggcaatcgtccgacggggcgaagcggagcgcaggctctacagcgagatcgcccaagccatggccgaccgggatgccgctctggcttcctaccgccaggcgaaggagcataccgacgccatgcaaaccgcttacgaagccgtcttgcagcgttatgaggaggggctgaatacggccatcgacctgaccactcaggccaatcggctcctggatgcccgtgtgcagcgactgagagcggccatgacctaccggctcaaatgcaaactcatagcctattacggctgcctttcggac

SEQ ID NO: 72 - DNA, 2886 bp, Porphyromonas gingivalis
gccatttttgtcgtatcattgcaaattgaaaaaataacagagaataagtataattcagacaagagcatgaacaaattttacaaatcacttttgcagtcaggactggctgccttcgtgtcgatggcaactgcactgaccgcttctgcacagatttcgttcggaggggaacccttgagtttctcttcaagatccgccggaacgcattcattcgacgatgcaatgactatccgccttactccggatttcaatccggaagacctgatcgcacagagccgttggcaatcgcaaagagatggccggcccgtccggataggacaagtaataccggtggatgtggactttgcatccaaggcttcgcacatctcttccatcggagacgtagatgtatatcgcctgcaattcaagttggaaggagccaaagccattacgctttattacgatgcattcaatattccggagggcggacgcctctatatctatacccccgaccatgaaattgtgttgggagcatatacgaacgccactcatcgccgcaacggagcttttgccacagagccggtaccggggagtgagcttattatggattatgaagtgtctcgcggagggactttgcctgacatcaagatctccggtgcgggttatatattcgacaaagtcggcggacgccccgtaacggataaccattacgggatcggtgaggacgattccgattcggattgcgagatcaacatcaattgtcctgaaggtgcagactggcaggcagagaagaacggtgtggtgcaaatgatcatggtaaaaggacagtatatctcaatgtgctcaggcaacctgctcaataatacgaaaggagactttactccgctgatcatttctgccggacactgtgcttccataacaaccaatttcggtgtaacgcaatccgagttggataagtggatcttcactttccactatgaaaaaagaggatgcagcaatggtacattggccatcttccgtggcaacagtatcatcggagcttccatgaaggctttcctcccgatcaaaggtaaatccgatggtctcttgctgcaactcaacgatgaagtccctctgcgctatcgtgtctattacaatggatgggacagtacgcccgatattccctcgagcggtgccggtattcatcatccggccggagatgccatgaagatttccatcctaaagaagactccggctctgaatacatggatctcctccagtggttccggagggactgacgatcacttctatttcaaatacgatcaaggtggtacggaaggaggatcgtccggttcttctctcttcaatcagaataagcacgtggtcggcacactgaccggaggtgccggcaattgtggcgggacggagttctacggcagactgaacagtcattggaacgagtatgcatccgatggcaatacgagccgcatggacatctatctggatccccaaaacaatggccagacgaccatcctcaacggaacgtatcgtgacggttataagcctttgccctctgtgccccggctattgttgcagtctacaggcgatcaggtcgaattgaattggacggctgttcctgccgatcaatatccatcatcttatcaggtcgaataccacatattccgaaatggaaaggaaatagctacgacaaaggagttgtcctattcggatgccatcgacgaaagtattatcggtagcggtatcattcgatacgaagtaagcgcacgcttcatttatccctcgccgttggatggagtggaatcttataaggatacggacaagacttctgccgaccttgccataggagacattcagaccaagctgaagccggacgtaacacctctccccggaggaggagtatcattaagctggaaagttcctttcttaagccagttggtttcccgattcggagaaagccccaatcctgtgttcaaaacctttgaagtgccctatgtttctgccgcagccgcacaaacccccaatcctcccgttggcgtagtcattgcagacaagtttatggccggtacatatcccgaaaaggctgctatcgctgccgtttatgtaatgccatccgctccggactctactttccacctcttcctcaagagcaacacaaacagaagattgcagaaggtgacaactccctccgattggcaggccggaacatggttgaggatcaatttggataagccgttcccggtgaataatgaccatatgctttttgccggtatcagaatgcctaataagtacaagctcaatcgtgctatccgttatgtaagaaatccggataaccttttctccattaccggtaagaagatttcatataacaacggagtctctttcgaaggctacggaataccctcgctcttgggctatatggctatcaaatatctggtggtaaataccgatgctccgaagatcgatatgtcgcttgtacaggagccttatgctaagggaacgaatgtggctccattccccgaattggtcggcatatatgtctataagaacggaacatttatcggcacacaggatccatccgtcacaacttattcggtttcagacggaacagagagcgatgaatacgaaataaaactggtatataagggatcgggcatttcgaatggcgttgctcagattgagaataacaatgctgtcgttgcatatccgtctgttgtaacagatcgtttcagcattaagaacgctcatatggttcacgctgccgccctctactcattggatggcaagcaggttcgttcttggaacaacctccgcaatggcgtgacattcagtgttcaaggacttacggccggtacttatatgctcgttatgcagacggcaaacggccctgtgagccaaaagatcgtgaagcag

SEQ ID NO: 73 - DNA, 2106 bp, Porphyromonas gingivalis
tggaaaaaaagtaatcctcaataccggggcaggacagcaaattaccgagatcattataatacagaaagctatttaagcctaaggaggaatcaaacaatgaaatatcttatcagactcttcttatcattgatgttactctctctctggacgggctgtacacacgaggagctctctatttgcgatggcgagaatacgcttgttttacgcgtagagaccggtaaagccccaaatgctcgtgccacagaacccggtcagggcatatacaatgagaataaagtaggctccatttctgtgctcttctatttagagggacaacttcgttggcaggtgaagtctacagactatcaaatccatgaaggggcctatatcattccggtcaaagagcaaatgcgaccactattcaatggcaacaacaacttcagcatctatgtagtggccaatctcgatttcaatgctccggccacagaagctgcgctttctcaatttgtggtagagaaatctattgaagtctcttctacgacagcccctgccgatttcgtaatgcttgctcatggcaataagcagatcaatatggctacgacagaagggaaactgttgggggattataaactcaaacgagtggcagcaaagattcgcatgataaaacccaccatcaatgtgcaaggatatgaagtggtcggaaatatacaggcaaagtttcgcaattcggtaacgaaggggttccttaccacagaagctcaagagatcccagctgctgcatcctataagacatcggaatatcttgatattgcagagtcggcacctgccaattctatccatttctattcttactataacaaatggacactctccacaccggagaagcgaccggaattcttcatcatggtcaaattcaaaaagacaggacagccggacaacacagccaaaccgtactactacagagtgcccctcgaatctcaggacaatcaggtcaagagcaatgtcctctataatctgaatgtgaaaatcgaaatcttgggttctttacaagagccggaagctgtttctgtaaacggcacactcgcaatagaagaatggattctccatcaggatgcattcaatctgcctgccaccaattacttgatagtggaacagcacgaaatcttcatgaataacgtgaacacatactcggtgaaatatcaaacttcgcagaaaccaatcagcattagcatacagtcagttacctttagctacgtctcttctgatggcactcagcacaatgatcttgtagcaagtagtagcgaccagtatcctacgattacaagcgataatacaagcatcataatcacttccaagataccggttaataacgtaccaaagaagatcgtttttgaggtaactaatggggtagccggtttgaaagagactgtcacagtactccaatatcctgcacaatttattgtcaatacacttggcacagcatcggcatggagaccagacggatctttggctccggggcttaacaataaagcgatttaccatgtcgtagtactggttccacccgagaatttatttgaagatgggacacagacaatcatcggttatccccccactgaaacaatttcttttcataagaaagagaacaatacctatccgatagtatggtctgacacaaatacgacaaaacaggaccttgagacatcaagaatgatttcaccttcctttgagttagcctcccaacttggggctactctcccgatgccctatctcgagtattggccagggacatcatatctccttgactattcgggaaactataataataagagatacgccttgtttaattgcgctttttactgggagaaaagaaaagttaataacgaagaaattaaattcgatgactggcgtttgccgacagaagctgagatcaaattgatagataagctgcaacataatgagcagagtgctgtccaagctatcatgacagggaattattattgggatagttactctgcaaatgggtcttataaaatgcaaggaggagggggccaaggaaattcctccaaagcctatgttcgttgcgtgcgggatgtgaaaaagccgattcgtgacaagaagtcaggtaag

SEQ ID NO: 74 - DNA, 3936 bp, Porphyromonas gingivalis
aagagggtagatagctatgaatgcagacaaaaagcttgcaaatgtgcaatttgtgtgatacaaaaatttactaatgtaaaactaaatgatatgcgaaaaattttgagctttttgatgatgtgctctctgcatttaggtctacaatctcagacttggcatggagatccggactcagtggcagccctaccttctatcggtattcaagagtcaagttgtacccgaatcacgttcgaggttgttttccccggattttatagtgtggaaaaacgagaaggcaaccaagtctttcagcgcatttccatgccgggttgtggctcgtttgggaatctgggcgaagctgaattgcctgttttgaaaaagatgatagccgttccggaattttcaacagctaacgttgctgtaaaaatcaaagagacggagacattcgacaattataatatctatcctaatcctacctatgtcgtagaggagttgcctgagggggggacttatctggtagaggctttcgcgataaacaatgactattatagccaaaatgtaagcctcccttctactcactatgtctattctcaagacgggtattttcgctcacaaagatttatcgaagttaccctgtatccttttcgatacaaccctgtccgacaagaaattctatttgcaaaaaaaatcgaggttacaataactttcgataatcctcagccacctttacaaaaaaacaccggcatatttaacaaagtagcctcctctgcatttattaattatgaagctgatggcaaatcggcgatagaaaatgatatggtgttcagtcgtggtacaacaacgtacataagcggaaatgttgccagcaacctccctcagaactgtgactacttggttatttacgatgatatgttcaacgtaaatcaacaaccacacgacgaaatcaaacggctgtgcgaacatagagccttctacaacggctttgatgtagctgctgtaagtataaaggacgtattgaatagcttcccatcaaatgccacctcatacatcaacgaaactaaactgaaaaatttcattcgctcagtttacaaccaaagcaatgcgaagaggactttagatggcaaactgggatacgtgctactgatcggaaaaccattgagcaaatatttggctgacactgataatacaaaagtcccaacctcttttattcataatgtctccttaattccaagtcatccaacttttggttccatatgcgcctccgactatttttttagttgtgtttcgccccttgatactgtcggcgatttgtttatcggtcgatttagcgtcaccaatgctcatgaattgcacaatctgattgaaaagactatcaacaaagaaatctcatataatcctattgcacacaaaaatattctttacgcagaagggaaaggctgcgatgctccaatcttacgtttattcttaaaagaaatcgcctctggttacacagtcaactctatcttaaaatctaatcaggtctctgcaatagactcgatatttgactgcttgaataatggttcccatcatttttattttaacactcatggaatgccgactgtttgggggatagggcagggactcgacgtcaatactctaacagcccgattgaacaatacatcttcgcagggattatgtacgagtctatcatgtagttcggctgtagcagattcaactattagatcgcttggagaagtcctgaccacatacgcacctaacaagggattctcggctttcttaggaggaagcagagccacccaatatgccgtttatttagaaggcccctgtcctccgtcagaattttatgaatatttaccttattctttatatcacaatctctcgactgttgttggcgaaatgttgctatcatccattatcaatactaattctgttgatacgtattcgaaattcaacttcaatttgcttggcgaccctgcactaaacattatggctcatggcatggaggttagtaattgtattacactaccaaacaacaccattataagcagtccgataacaataaaaaatggtggctgcctaaaaataccggaaaaaggagttttgcattttactaataatggctccatacaagtcatgtccggaggaactctggaaataggcaatcaggctaaaatatccggagagaccggtgctaaccccacctttattaccgtttacggcgatggtcttgcgattaacaagcaggtagagatagacaatatagaccgacttaacttgttttctacgcattcggtcatgcccaaatttcattttgacagtgtgaaattcaacagtgccccgctgtatacaacgaactgtattgtggagataagcaattgcgaatttaccaatcgaagtgacattatttcaaagaattgtgacctaagcgttgaaaacagtatgtttagcagttcggggataacggtattcaagcctatggctacaagctccatcaccggattatctacaaaagcaaagattaccgacaatactttttttgcgacaggaaacttcgcctaccatatcacaaacacgccaggcttaacagcaacctccaatgctgccatcaagttagacaatattcctgagtattacatttccggtaataaaatagtcaattgcgatgaggctcttgtactaaataatagtggcaacagaacgaacagactccacaatatcacacggaatgtgataaaaaactgtaggattgggagcacgctttataattcctatggtatttacaaccgaaataagatcagtaacaatcatataggagtacgtctcctcaacaacagttgtttttatttcgataatgctcctgtaatcaatgaagaagataagcagacgtttatttctaataggacttggcagctctattcatcaaacggtacattccctctcaacttccattacaacagcttgcaggggggagatacagatacatggatttacaacgacacgtatacgaatcgctatattgacgtttcaaataatcactggggcaacaatgatttgtttgatccgaatcaggttttcaatacgccagacttgttcatttggatacctttttgggatggattgccaaatgggagatcgggcaatagctctgctgaagcagtagaattccaaacagcattggactgtattggcaatagcgattatctttcggcaaaagtggctctcaagatgatggttgaaacctacccggaatccgactttgcaatagctgctttgaaggaattgttcaggatagagaaaatgtcaggcaacgattacgaaggcttgaaagattatttcagatccaatccaaccatcatctcttcccagaacttgttcccgacagctgatttcctgtctgcgcgatgcgatattgtgtgtgaaaactatcagtctgccatcgattggtacgaaaatcgcttgaatagtgaaatctcctatcaggacagtgtttttgcagtcattgaccttggtgacatttattggaatatgcagttagactcactcagagggactggtatagatttgaacatactttcctgtgaacaaaggaaatcgctcgaaagccatcaaaatgtaaaaaattatttgttgtcaactcttcccgaatcaacaggtactctcctgcctccattagaatgcaacaaatcaagccttgataaatccaagataatctctatttcgcccaatccggcgaaagctgttgtaacaataatctactataccgataacccttcctgttctgtaataaaaatatatggaataaatggagcctcggctgatataaccgggttgcccaaacatctatccgaaggttattacagcatacagttcaatacatccaactttgatcccggtttctacctggtaacgctaaatgttgatcagaaaattatagatacggaaaaattacgaatcaaa

SEQ ID NO: 75 - DNA, 2814 bp, Porphyromonas gingivalis
tcagaaaattatagatacggaaaaattacgaatcaaataatggctatcatgatgaaaagtattgtttttagagcatttctaacgattttgctctcgtgggcagcgatcacgaatccgactgctcaagagatctcaggcatgaatgcatcctgtctggctgctccggctcaaccggatactatcttatatgaaagttttgagaatggacctgttcccaatggctggcttgagatagatgctgatgctgatggtgccacttggggaagcccatcaggctctttctctgtaccttacggacacaatggcctttgcacctactcccatatacgttccggtatctcaacagcgggcaactatctgattacacccaatatagaaggagccaaacgggtcaagtactgggtatgcaatcagtatagtaccaatccggaacattacgcagtaatggtatcgacaacggggactgccattgaagactttgttttgttgtttgatgattccataacagggaaaccgactcctcttgtatggcgtagacgaatcgtggacttaccggaagggaccaaatatattgcatggcgacattacaaagtcaccgactcacacacagaattcttgaaattggatgatgtcactgtgtataggtcgatcgaagggcccgaacctgctaccgacttcacagtaatcaatattggtcagaatgtgggacgattgacttggaactatccggaggattatcaaccggaaggaaaggggaatgaagagttgcagcttagcggctacaacatctatgcgaacggtacactactggcacaaataaaagatgtctccatactggagtatgtggacagcacttactctttgcgagacaatcccttgcaagtggagtactgcgttacagccgtttacgatgaaagcatagaatcttcgaccgtatgtggcacgctgcattacgccacggatgccatcctttatgaaaattttgagaatggacctgttcccaatggttggcttgtgatagacgctgatggagatggatttagctggggacactatttgaatgcatacgacgcttttcccggccataatggaggccattgctccttgtcggcttcttatgttccgggtataggcccggtgactcccgacaactatctgattacccccaaggttgaaggagccaaacgtgtcaagtactgggtaagcacgcaggatgccaattgggcagcggaacattacgcggtgatggcttcgacaacggggactgctgtcggagatttcgtcatattgttcgaagaaaccatgacagcgaagccgaccggcgcatggtatgaaagaaccatcaacttacctgaagggactaaatacatcgcatggcggcattacaactgtaccgatatatatttcttgaagttggacgatatcactgtattcgggactcctgcatcagagcccgaacctgttaccgatttcgttgtctcgcttattgaaaacaacaagggacgattaaagtggaattatcctaacggctacgaacccgataagactgatgataaagacccattgcagcttgccggctacaatatctatgcaaacggctcgctccttgttcacatacaagacccgactgttttggagtatatcgatgagacttattcttcacgagacgatcaggtggaagtggaatattgtgtcactgccgtttataacgacaatatcgagtcccaatcggtttgcgataagctgatttatgattctcaatcggacattatcttatatgaaggctttgaggccggaagtattcctgaaggctggttgttgattgatgctgatggcgacaatgttaattgggactattatccttggactatgtatggacatgacagtgagaagtgtattgcatccccttcgtacttaccgatgattggcgttttaactccggataactatttggttacacccagactcgaaggagccaagcttgtcaagtattgggtaagtgcgcaagatgctgtttattcggctgagcattatgctgtgatggtttctactacgggaactgctgttgaagattttgtcctcttgttcgaagagacaatgaccgctaaggctaacggtgcatggtatgagcgaactattacattgcctgcaggaacaaaatatattgcctggcggcattatgattgcaccgatatgtttttcttgctcttggatgacattacggtttatcgttctactgagactgttcccgagcctgttactgatttcgttgtctcgcttattgagaataacaagggtcgcctgaaatggaattatcctaacggctacgaacccgataagactgatgataaaaaaccattgcagcttaccggctacaacatctatgcaaatggctcgctccttgttcacatacaagacccgactgttttggagtatatcgatgagacttattcttcacgagacggtcaggtggaaatggaatattgtgtcactgccgtttataacgacaatatcgagtcccaatcggtttgcgataagctgaactatactatcacatccttggataatattcaatctgatacaagcttgaaaatatatcctaatccggcatcgtatgtggtaaggatagagggattgagtcggagcaagtcgacaatcgagttgtataatgcgctgggaatttgcatattaagggaagagactcattcagagaaaacggaaatcgatgtttcacgtctcaatgacggagtctacttgattaaagtagtcggtggaaataaaacaacaaccgaaaaggtagagataaagaggccg

SEQ ID NO: 76 - DNA, 1818 bp, Porphyromonas gingivalis
ataatcttctgtacgattcatcactctgagttggaaataatgaacagcatcatgaaatatcaattatatacggccgtcataatggctctctctgtatcatccgtttgcggtcaaaccccacgaaatacagaaaccaaacgccccgacacgctgcgcagggagcttactatcgttaatgaccagactgtggagatggagcatgcggatccgcttccggctgcatacaaggccatcgaacctcgattaaaacctttccgtccggaatataacaagcgtacattcggatttgtccctgaagtttcctcttcaggcaggaacaatcttccgaatatcctgccgacggaaggtcatatgaagcaccgggggtacctgaatatcggtatcggccatacgctaaaccagcgaatggatgccggctatcgtctgatagatgcagagcaggagagactgaatcttttcctctcctatcgtgggatgaaatcggctttcaataccggtgacttcgacggcgacagaaaggatagacgaatgatggcaggagtggactacgagcagcgcaggccttcctttgtgcttgctaccggcttgtattattcgaaccattatttcaataactacggacggggagctaccaccaatgtgggcagcatccctcagctatcgacacctgttactcctcagatggacaacgggacccacaacgtccgtgtatacttgggtgcaaaaaatgatgtgatcgatgccaggatcgactatcgtttcttccgttctattccctatctgggtaccgatccgatgaaggctctcacagaacatacgcctgaactgaacgtgacgatgagtaatgagttgtccgatgatattaagctcggtgtcgaagttcgtacgggaggattgttttttgccaaaaacagcgaaatgattcaaacgggcgttctgtccgaaaccgaccgcaacctgtattatgtggagggcgcgcccacaatcggatttgtcggagactcggacaatatgcaatggaacatacaggccggagtagggatttcttcccatttcggagccaaagggaggttgtttttctggcctaaactggatgcttcgcttagtatcttcccttcatggcgtgtgtatgcgaaagccttcggcggtgtgattcgaaatggtctcgccgatgttatgcaagaggagatgccctacctgatgcccaatacgattgtactcccttcgcgcaatgctttgaccgcccaattaggggtgaaggggaatatagccgatgtggtacgtatggaggtttatggcgacttctccaagctgacaggtgtgcctttctatactccgactctacccttatataatccatccgacttgtatcagtataatgtgagtttcttgccgatatatgccgacggcagccgctggcgcgcaggtggtaagctggaatactcttatcgcgatatgctccgctttctggtagacgcatcctatggcaagtggaatttggatggaggacttgtcgcctccatgcagcccgatcttatattgaaggcagaagtaggtgttcatcccattgccccattggatgtcagactccggtatacacagctgaacggacggtatcggtattctttcggctcggctggctcggaagccttgggtatcggtaatgtacatcttcttagtgcggatgtttcatacaagctgaaaaagaacttgagcctttatctcaaaatcgataatatgctggcggaaacgacagagcttatcggttattatcctatgcagccgttccattgtttcgccggttttagctggactttc

SEQ ID NO: 77 - DNA, 1071 bp, Porphyromonas gingivalis
aactcccatgcaacagtctccgttatatgttcaatgatggaaaaatgtatctttgctcactatccacataaccttgtgttcatgattcgcaagcatttcggtatcattttgggatttctttctcttgtgttttcggcaggtgctcaacaagagaagcaggtgtttcattttctgaaccttccggctactgcacaggctttggctgccggaggcaaagctatcaccatcgtagacgacaatcccggactggcttttgagaatccggctctgctcggatatgaatccggtggccgcgcctttctttcctatttatattatatgagtggttcgcatatgggcaatgcctgttatgcctcgtccgtcggagagcgtggcatgtggggtgttggcatgcgtttcctgaactacgggtctatgcaaggatacgatcagaatgcgattgccaccggctcttttagtgcttcggatatagctgtacaaggattttacagccatgaactgagcaaccacttccgcggtggagtcagcctaaaagcattgtattcttctatcgagacgtatagttcctttggccttggtgtggatgtcggtatcagttattacgacgatgacaaaggatattccgcttccgctctgttcaagaacgtaggggcgcaactgaaaggctataatgaagaacgggaaccgctcgattgggatttccagctcggcttttcccgcagttttatcaatgctccgtttcgcttgcacatcacgttgttcaatctgaatccgcactatttcaagcgtcttgtaccacgcgatctgtccaagatgcaaaagttcctccgacacttctcgataggagcagaatttactccttccgagaggttttgggtcgggctgggatatacgccacagattgcacaggatttcgaggtggaaggcggcaacaaatggggaggtctttcggccggcgtcggtttcacttcaggtgtagtacgtgtaggcgtatctgctgccacctatcatcctgcagctctttcgttcatgtgttcggtaggtatccgtttggacgataagagcatcttc

SEQ ID NO: 78 - DNA, 1011 bp, Porphyromonas gingivalis
cctcagcccgtcggccttaaagaaataaccattaaacccatgtgcctcgaacccataattgctccgatttcatccgagttgctcgagcaggagctgactgccgatcgttttctgcggatgacaaacaaagccggcaatgagatctatgtttttacggccgaagaagctccgcattgcatgaaagaagtaggccgactgcgagaagaagcctttcggcattatggcggaggtactggcaaggcgatcgatatagacgagttcgacaccatgcccgggagctacaaacagctgatcgtatgggatccgcaaaacaaggctatactcggaggctaccgctttatctatgggcgggacgttgctttcgataccgatggcaagcctttgctggcaacggcagagatgtttcgcttcagtgatgcttttttgcacgattatctcccctacacagtcgaattgggacgttcgttcgtgtcgctccagtaccaatcgacacggatgggcacaaaggccatttttgtgctggacaatctttgggacggtatcggagcactcactgtagtcaatccagaggcactctatttctatggcaaggtgaccatgtacaaagactatgatcggcgagctcgcaatctgatcctgtattttcttcgcaagcacttctccgatccggaaggcttggtcaagcctattcatcccctaccgatagagatcagtgcggaggacgaagccttgttctcctcatccgactttgacaccaattacaagactctcaatatagaagtgcgcaagctgggtatcaatatccctcctctcgtgagtgcatatatagctttgtctccggagatgcgtgttttcggcactgcagtgaatgagtctttcggagaggtggaggaaaccggcatattcattgctgtgggtaagatcctggaagagaaaaaacaacggcacatagagagcttcatcctcagccggaacgaaaaaaaaggtctcgacagtagcaatggccgatca

SEQ ID NO: 79 - DNA, 1698 bp, Porphyromonas gingivalis
tacgacggagcgagactggtctataccctatttcggaatagaaacgacattcaccctatgaaaaccattgtaagatacagccgccttccggtcgctctcttcttttgccttttgggagctgtgcacttgtctgtcgaggcgcagatgctcaatactcctttcgagctgtcggatcagatcgtcctgtctcccaccgaaaggcaatacagggagatttgtgtgcaaacgaaagaaaaaaggggggccgatcttttcccgttgagcgataagctgcgcgattcggcctatgttcgtttcggctcggcctatggcgatattgcgggcgactatcttccgtacaacggcaataactactcctcgctctcgctcgaatcgggtggtcgcatcagtgtccgtaactatggcacattgcagggcagtgcttcctactcacgtggcatgcacaaacgcatcggctggaatgctctgcgcaacgccgaagcctactatccctatttggtgtccgattcgaccggcggagactatcatttcgaagactatcggcttgccggctactattcttttcgcgccggccgcttgcccctcggtataggcttctcatacaggggcgaagttgcttatcggctgaccgatccgcgtacgaccaatacgaccggtgcattggagctttcttgtgctacctctttgacgctgcctcgagagaacaggctatcgctttcggctgcgtatctctatcatagacaacacctcacacagtacaactggcgtcccgggcagcaggacaaattcttcgtcagctacggtttcggtcaggtggatgtcagcaacagccctatctggttcggtatctccagaatgaactacgtcaacggatggaagcttagctcccgtctggatacccgtaggggcgatgccatcggtctcgactacagcggctacttcctcgataccgaagagaggtcgtccatcaatctctttgctttgctttacaatcgcctgcgactctatggtagctggcatctgtcggacttcgatttttcattttcagccgactatgctctgcgccaagggatagagcggatatacgaagactacaagccggatgataattatcatatctacgacctccgtatcttggccattcgccgctggtatatgctcaatgagttttctgcccaagcccaagcctcctaccgtattcgcacggatagaggttgtgccctgagagtgagtgccggtagtgatttctacggctatgatgagacgtatcgcaagcatggacatcataccatgagcggaatgctacgtccttttgccggtatagcctatgaccatgccggatccaaattggattttggactttcgctttcggctgcttatcgaatggtgctgacgcattcgtataagattcgtaccatccagaaagagcagctcgactatcagctggcctatttgccctatgcctatcgtaatagagaaggcgtggaggtgcgttcctctctgtacgtctcgattccgatgcagaatacccaccgcctgatgacagagctgcggttgtatggcgacctgatgaaaagaaaggacggtatagcctatggcaaaacgcccggtgtcatctcacatatcctgtccgatccgcaagccgaacgaacgtccggccataccatcggggctatctgcaatatctcctacctcttc

SEQ ID NO: 80 - DNA, 2457 bp, Porphyromonas gingivalis
aggacgaacgttttcttatctttgtcccataaaattgggagaaggggtgcttcctgtagcaatcggaatgcgtggatggctgagaacaaaccctcatcacctgaaccggataataccggcgtaggaaactctccgtctgactatcttcacggcgaagcaatcattccccctctctcttctttgtccaacttcaatgataagagatttatgaaaaaacttcacatgattgccgccttagccgtcctgcctttctgcctgacggcacaagcacccgtctccaacagcgagatagatagtcttagcaatgtgcagctccagaccgtacaggtcgtagctactcgcgccacggcgaaaacccctgtcgcttacaccaacgttcgcaaggccgaactttccaagtccaattatggtcgtgacatcccctatctgctgatgctgactccctccgtggtagccaccagcgatgccggtacgggtatcggatattccggctttcgcgtgcgtggcaccgatgccaatcgcatcaacataactaccaatggagtacccctcaacgactccgaatctcagtccgtcttttgggtgaatatgcccgacttcgcctcttccatcgaagaccttcaggtgcagcgaggtgtgggtacttccaccaatggtgccggagcttttggggcaagtgtcaatatgcgtacggataatttgggactggctccttatggccgtgtcgatttgagcggaggttcgttcggcacattccgccgatcggtcaaactcggtagcggacgcatcggtcgccattgggcagtggatgcccgcctgtccaaaatcggttcggacggctacgtggatagaggaagcgtggatctgaaatcctatttcgcacaggtgggctatttcggtagcaacacggctctcaggttcatcactttcggaggaaaagaagttacgggtatcgcatggaacggtctttccaaggaggatgaagccaaatatggccgccgatacaacagtgccggtcttatgtacgtggacgcgcaaggagtaccgcactactaccacaataccgacaattacgagcagcgtcactaccatgccatcatgacgcacagcttctctccttccgttatcctcaacctcacggcacactacacggccggatatggctatacggacgaatatcgtaccggacgtaaactaaaggaatatgcactgcagccctatgtggaaaacagtgtgaccgtgaagaaaacggatctcatccgtcagaagtatctggacaatgacttcggaggactcatcggttcgcttaactggcacaccggtgcatgggatttgcagttcggggcctcgggcaatatctataaaggagaccacttcggccgtatcacttacatcaaaaagtacaatcagcccttagctcccgacttcgaatattatcggaacagggcagacaaaagagaaggtgcagcctttgccaaagccaactggcagatcactccggaactgaacatgtatgccgacctccagtatcgtaccatcggctacacgataaacggcatcacggacgaatatgatgaggtacagggaagtatgcagcacatcgatttggacaagaccttccgcttcctcaatccgaaggccggtcttacctatagtttcgacgatgctcatactgcctatgcttctgttgcggtagcacaccgcgagcctaacagaaccaattacaccgaagccggaataggacagtatcctacgcctgagcgactgatcgactatgagctgggctaccgctatgcttcgcccctcttgtcggccggagtaggtctctattatatgcaatacaaggaccaactcgtgctggatggccgtttgagcgatgtgggacagatgctcacaagcaacgtccccgacagctaccgtatgggactggagctgactctcggttggcagatccttcctcgtttgctgcgttgggatgcttctttcactatgagtcgcaacaaaatcgaccgctacgtacaatatacatccgtatatgatgcggactacaactggctcgaactcaaggaggagaccctcgaaagcacggatatagcctactcgcccaatgtcattgccggcagcatgcttaccctctctcatgccggtttcgaaatggcttggacgagccgcttcgtcagcaagcaatatctggacaatacacagcgcagcgatcgcatgctttcctcctattgggtgaacgacctccgcctcggctatgtgctgccggttcacttcgttaagagagtggcactgggcgtacagctcaataatctcttcaacctcatgtatgcgtccaatgcctacatctacgatgccggttacgtacaggcatccggagaactaagtgcatatgccgatctgcgttattatcctcaggccggatttaatgcactgggtagtctgacaatcgatttc

SEQ ID NO: 81 - DNA, 1596 bp, Porphyromonas gingivalis
tacaggcgatcgggaagggtttgtcctcgtatcctccggaacaaacgttcctacgcagatactcggttacagccgagaagagcggttcgactacgagccggcaccagaacaaagatgaaaagaaggtttctatcgctgttactgctgtacatactctcttccatcagcctttctgctcagcggtttccgatggtgcagggaatcgagttggataccgattcgcttttctctctgcccaagcgtccttggcgcgccatcggtaaaacgataggcgtcaatctggccgtatggggcttcgatcatttcatcatgaacgaggactttgcagacatcagttggcagactatcaagagcaatttccaaacaggctttggctgggacaatgacaagtttgtcaccaacctcttcgcacatccttatcacggatcgctctatttcaatgcagcgaggtcgaacggtttgagcttcaggcactctgctccgtttgccttctttggcagtctcatgtgggagctgcttatggaaaacgagccaccgagtatcaacgacctctgtgccaccaccataggcggtatagctttgggggagatggggcacaggctgtcggacctgctcatcgacaatcgtaccacagggtgggaacgtatggggcgcgaggtggctatcgctctgatcaatccgatgcgctttctcaaccgtctgacagcaggagaggtgacttctgtcgggagtcgcagcggacagatatttcagtctgtccccataaacatagtcgtcgatgccggctttcgctttttggcagacaagcggcatgcccgaaccggtgccacggctctgaccctgaatctgagattcgactacggcgatccattccgaagcgagactttctctccatacgatttcttccaattcaaagccggattgagtttctccgaatcgcaacctctgctgagccagatcaatctgatcggaatcctaagcggatgccaactgctcgcacacgaacgaacggttttggtgggaggtctctttcagcacttcgactactacaattcggaaaaacgaataagcaaaaattcggaggaggtactcgtcaccccataccgtatctcgcaagtggcagctctgggaggcggtcttatcttccagcaccacggaaaatttcgacgacgtcctctggagctatatgccgagacctacctgaatgtcgtcccgatgggagccagtctgtcggatcactacaacgtggacaatcgggactataacctcggcagcggattgagcggcaagctataccttggtgctacgtacaatgatctgtggagctggctcttgggagtcgaaagctatcggctctacacatggatcgggtatgaagagccgcaccagaaaaataccgatgtcagctcttttatggtgcagggggacgaaagcaaggcgcgcctactggtgacgagttccgagttcgcatttcatcctggcccctggcatgtagccatcgtcgctcgccgtttcatccgcaaaacagcctatcaattctaccctaacgtatcattcgataccggcgacatacagctgcgtgtcggatttcacttc

SEQ ID NO: 82 - DNA, 900 bp, Porphyromonas gingivalis
aaaagaagaaaaaaacagatgaaacgactgattgtttttctggcaatgggtggcttgctgttcacccttgcgaacgcacaagaagcaaacactgcatctgacactcccaaaaaggactggactataaaaggtgtgaccggactaaatgcctctcagacttctctgaccaactgggctgccggtggagaaaacacggtggcaggtaacctctatttgaacatagatgccaactacctgaaagataaatggagttgggacaacggtttgcgtacagacttcggtctgacctacacaacagccaacaagtggaacaaaagtgtagacaagatcgaactcttcacgaaggccggctatgagatcggcaaacattggtacggaagtgcgcttttcactttcctctcacagtatgccaaaggatatgagaagccctcggatcacttgacaggagtcaagcatatctctaatttcttcgctcctgcatatctcactctcggtattggtgcggactataagcccaatgagaagttctctctctacctctctcctacaacgggcaagctgactgtagtagcagacgactacctctcaagtttgggagccttcggggtgaaagttggtgaaaagacaatgttcgaacttggtgctttggtagtgggttcggccaatataaatctgatggagaatgtcaatttgataaccaaggcttcattcttctcggcttatacgcacgactttggcaacattgacatcaattgggaggctatgctggccatgaagatcaacaagttcctcacggctacgatagccaccaatcttatctacgacgatgatgtgaagatcaacgatggcccgaaaatccagttcaaagaagttgtgggcgtgggtgttgcgtacactttc

SEQ ID NO: 83 - DNA, 663 bp, Porphyromonas gingivalis
acgagagagagtgtgttacattgtagaacaaaactcaaaaaagaacgaaaaatgaagaaaatgattttggcagctactatgctgctcgcaacaatcggttttgcaaatgctcagagtcgtcctgctcttagactggatgctaactttgtcggtagtaacttaatgcaaaaagtcgcaaacacgagcgtgaacaataagatgatcgtaggcttacgtgttggtgctgctgctgagttcgctcttagcaatgatggattctatctcgcccccggattggcctatacgatgagaggtgctaagatggaatcactaagtgaaacgacaactcgcttgcattatctgcaaataccggtgaatgccggtatgagatttagctttgctgacaacatggctatttcattggaagcaggtccctatttcgcatatggtgtcgccggaacgattaagactaaagttgcaggcgttacggcttctgtagatgcctttggtgataacggatataaccgtttcgacttgggcttgggcttgtctgctgccttgagctacgaccgttattacgtacaaattggatatgagcatggattgcttaatatgttgaaggatgctccggataagacttctttgcgtaatcatgacttctttgtgggtctcggtgttcgcttc

SEQ ID NO: 84 - DNA, 744 bp, Porphyromonas gingivalis
atcaaacgaatagaaatgaaaaggatttttactgtagcccttgtgctacttgcttcggtcactatggccatcggacaaagccgcccggcacttcgcgtagatgccaacttcgtaggcagcaatcagagcatgaaaagagacggatatgtgtgggacaccaaaatgaatgtcggcctgcgggtcggtgccgctgccgaattcatgatcggatcaagaggattctacttggctccgggtctgaactatacgatgaagggctccaaaaccgaatgggatatacccgaaatggttcctggtacctatattacgatggtttccactcgcttgcactatctgcaactgccgatcaatgccggcatgcggttcgacctgatgaatgacatggcggtttcgatcgaagcgggtcctttccttgcatacggtatatatggtacatatcggcagaagttggaaggatggaagccgaacaactacagcacagagttttttggcccaacgcttggtggcccaacaaatatccgctgggacatcggggcaaacataatagccgcattccactataagcgttattatatacagataggctatgaacatggatttgtggatattgtgtcaggtggaggttctgatattccccgactgaacgacaataggcaatcctcttcgacgaccgctctaagagaaaagggaaataacgaatacgcttataatcgtgacttcttcgtgggcataggttaccgcttt

SEQ ID NO: 85 - DNA, 633 bp, Porphyromonas gingivalis
aaaagaaagagtatgaaaagaatgctgctgcttctcgttgtattattatatggaattgcaggccgattggctgcacaagacgttatcagaccatggtcattgcaggtcggagcgggatactccgatacggagaacatcccgggaggattcacctatggtttctatttgggaaagcgtatggggagctttctggaagtggggctgtccatgtacaactccacacgtcaaacagccaacaatgcagactcctttgcatcgaacgaaggagacggatcttttcaggtaaatatgtcttctccgaatgagaagtggtcattcttcgatgcaggcagtgccaactgctatatgatcgtcgtcggagtcaatcctctccatctgttttggcagaatagccggcacaatttgtttctggcagtacaagccggcctgtccaataagcacaatattcatttcatctatggagacaagggagccaaagtcagtatctacaccaattcgaatacctacatcggttacggagcacgtgtagcctacgaatatcaaattcataaaaacgtgggggcgggtgccgctgtaatgtacgaccacggcaataagatgcttacggccatggccacgctctccactcatttt

SEQ ID NO: 86 - DNA, 2859 bp, Porphyromonas gingivalis
atccgaatgagagtatccgatctctgttccagactttcatggttattacccgtaatccttgtcggattgctctgtgctactttggtcgctgcggaacgtcctatggccggagcagtcggattgcaccaccgtcggcatgctgcgctgtctgattctacagcgaaagacacggtgcctctcgcaaaacctattcctgacagtgcttttcgagattcccttcctgccgattccaccggatcgatgcggcaagatagcgtgtatgacgatgaattcgaattggaagatatagtggagtacgaagctgccgattccatcgttttgctcggacagaatcgtgcctatcttttcggcaagagctatgtgagctatcaaaagagtcgcttggaggcaaacttcatgtatctcaataccgacagcagtacggtttatactcgctatgtcctcgatacggccggttatccgatggcctttcctgttttcaaggatggagagcagtcgttcgaagccaagaactttacctacaacttccgcacggagaaggggattatcagcggagtgatcacgcagcagggcgaaggctatctgactgccggtaagaccaagaagatgcccgacaatatcatgtttatgcaaggagggcgttatacgacctgcgacaatcacgatcatcctcacttctatatcaatctttccaaggcaaaggtgcatccggagaaagacatcgtcacaggtccggtcaatctggttatcgccgatatgccgctgccgataggtcttcctttcggctattttcccttttccaacaaatactcttccggtatattgatgcccacgtacggagaggacaatcgctatggattttatttgaggaatggtggatattattttgccttcagcgactatatcgatttggcattgcgtggggagatcttttccaaagggtcatggggcatttcagcccaatcgaaatataagaagaggtataagtacaacggctcgttcgaagccaattatctggtatcgaagtccggcgacaaatacgtgcccggagactacagcaagaccaccagtctgaatatccgatggacacacagtcaggatccgaaggccaatcctttgcaaacgttgtcggccaatgtcaattttgccaccgggagctatttccagaattcgctgaataccacctatgatgtcaatgcccgtactgctacgacacgaagttcggccgtgagctattcgcgcaagtttccgggtactcctttttcgattacgggtagcatggatatcagccagaacatgcgcgatacgacggtgagccttaccttgccgaatctttcgattaatatgtccacgcgttatcctttcaagcggaagacccgtgtaggaccggagcgatggtacgagaagttgagtgtgggctattccggtcagcttcgcaatagtatcttgacaaaagagaaagatttgctccagagcaatctcgtgcgcgattggaagaatggtatgcgtcattccgtaccgatcagtttgactgtccctttgttggattatatcaatctgactatgggggttaactacaatgagtggtggtacacgaaaggcatacggaagtcgtggaatgaggataagaaaacattcctgccttcggacacgacctataaattccgcagactgtacgattacagtctgtcggcaggcttatctaccacattgtacggtatgttcaagccttggaaacctttttccttcggaggcaatctcattatgatccgtcatcgcttcacgcccactgtcagtttctcctatatgccggacttcacgaaacgccgatatggcttttgggagcttcttgagcatacggatcagaacggcaagctgcatacgctgctctactctccttatttcgagcagatattcggtgctccctccatgggcaatgcaggatctgtcaatttctcttttgacaacaacttagaggccaagatcaaatccaaatcggattcgacagggatcaagaagatcagcctgatagatcagttcacatggtctacatcctataatatgtttgccgattcgatccgatggagcaatatctcggcttcgctggcacttcgcctctccaagagctttaccttgcgcttgtccggtctgttcgatccctatttgacgaagtattatgagggagaagatgggaagatcattccctataagagcaacgacctgcgcatttttaacggcaagggattggcacgcctgatcagtacgggtacttctttcagctatacgctcaacaaagagtcgctcagcggattgatagctcttttcagtggcaaaaaggagcggagagatgaaaagaaaaacacaggggctactcctcatgaaggagacgatgctgccgatatacttgagggaggaagaccgcaaaatgaaagtggggggtcgctcctcgagcgcaaccgtcagggcggagcagtggatcaggatggttacttcgcatattcgatcccatggagcctgtccttcgactatagttggaatattgctaccgactacaataggtacaatgtcaataagatggagcactactaccgggtaacgcagaatctgagctttcgcggcaatatccagcctacaccgaactggagcttcggattcaatgcgaactacaatttcgacttgaagaaaataacatcgcttacctgcaacgtcactcgcgacatgcactgctgggctatctcggccagtttcatccctataggagcatacaagtcctataatttcgtcatatcggtgaagagttcactcttgcaggatctgaagtatcagcagagcaatcgtcccatcacgaatacttggtat

SEQ ID NO: 87 - DNA, 3753 bp, Porphyromonas gingivalis
  modified_base (3024)..(3024): n is a, c, g, or t
aaatggaaattggcatgcgcttttgattgcgcgtgttgtttcgatccatttgtagtaactaacgaggtaataataatgatgaaacgatatacaataattcttgcagtttttcttttattctgcacggtatttacctttcaaataaaagctcgcccttatgaaagatttgcagatgtagagaagccttggattcagaaacattcaatggattctaaattggtgcctgcaaataagggtaacttaattcaagctgaaattgtataccaatctgtttctgaacatagtgacttagttatttcacctgtgaacgaaataaggcctgcaaatcgtttcccttcgcataggaagtctttttttgcagaaaatctacgggcatctccccccgtagttcccgttgccgtcgacaagtatgcggtaccggttgccaatccaatggatcctgaaaatcccaatgcctgggatgtgacgctaaaaatcactactaaagcggtaacagtacctgtcgatgtggtgatggttatcgaccagtcttcgtcaatgggagggcaaaacattgccagattaaagtctgccattgcatcgggacagcgttttgtgaaaaaaatgttgcctaaggggacggctacagaaggggtgcgtatcgctcttgtgagttatgaccatgagcctcatcgcttatctgattttaccaaagacactgcttttctctgtcaaaaaatccgggctttgactcctatttggggaacacatacccagggggggcttaaaatggcgagaaacattatggccacttctactgctgtggataagcatatcatattgatgtctgacgggttagcgacggagcagtatcctgttaaaaatgtaactactgcagacttcattggcaaaactggaaatgcgaatgatcccattgatttggttatacaaggagcaattaatttccctacaaattatgtttccaacaatccatctacacctcttaccccaaattatccaactcattcttctaaagttggacggagaaatctgccggaatccaaattcgattatagtaatctgagtgcaaggattacttttgatggtgttgctggcgcattggtctatgaaccgaggtttcctcatccctattattattatttcccttgtaacgctgctatcaatgaggctcagtttgcgaaaaactctggttatacaatccatactattggctatgacctgggagattttgccttggccaacaattcgttgaaactaaccgctacagacgagaatcacttctttacggcgacaccggccaatttagctgcagcgtttgataatattgcccaaactattaatataggtatacagaggggggaggtgacggactttgtagctcctggtttcatcgttaaaaatctgacgcaatcgggagatgttactcatttgctaaatgtttcaaatggaacggtgcactatgatgtctctactaaaaaactgacatggactactggtactatcctgagctcatcagaagctaccataacttatcgtatttatgccgatttggattatatacagaacaatgatattccggtaaatactacttctgctatcggcccggatcttggtggattcgataccaataccgaggcaaaattgacctataccaattccaatggcgaaccgaatcagcagttaattttcccacgtccgacggttaagttaggttatggtgttattaagcggcactatgtattggtaaataaagacggtcaacccatacaggcaaatggaacagttgtcagttccctaagcgaggctcatgttctacagtcacaagatttctttttgccctcaggtggaggtcatattgttcccaaatggataaagttggacaaaacgaccgaagcattacagtactattccgtaccgccgactaacacggtcatcactactgccgatggtaaacgttatcgttttgtcgaagtcccaggctccacgccgaatccgggccaaatcggtatcagttggaaaaaaccggcaggaaacgcttacttcgcttacaagctcctcaattattggatgggaggaacaacagaccaacagagtgaatgggatgtgacgtccaattggacaggagcccaagtaccgctcacaggagaagatgtagagtttgcaacgacagaaaatttcggttctccggcggtagccgatttgcatgtcccgacaaccaaccccaaaattatcggtaaccttatcaataattccgacaaggatttagttgttaccacaagcagtcaattgacgatcaacggcgtggttgaggataacaatccgaatgtcggtacgatcgtcgtgaagtcgtcgaaagacaatcctacggggacattgctttttgccaatccgggctataatcaaaatgtaggggggaccgtcgagttttacaatcagggatatgattgtgccgattgtggtatgtatcgcaggagctggcagtatttcggtatccctgtcaatgaatcaggttttccaattaatgatgtgggcggaaacgagaccgtcaaccaatgggttgagcctttcaatggcgataagtggcggccagcaccttatgcacctgatacagagcttcaaaaattcaagggctaccagatcacgaatgacgtgcaggcacagcctacgggagtttacagcttcaagggtatgatttgtgtgtgcgatgccttcctgaatctgacacgcacgtccggtgtcaactactcgggcgccaacttgatcggcaactcatacactggagccatcgacatcaagcagggtattgtcttcccgccggaagtcgagcagacggtgtatctgttcaacacgggaacacgcgaccagtggcgtaagcttaatggaagcacggtttcaggctatcgagccggtcagtacctctctgtacctaagaatacagcgggtcaggacaatcttccggatcgtattccatcgatgcattccttcttggtgaagatgcagaacggagcgtcttgtacgttgcanatcttgtacgataagctgctcaagaacacgactgtaaacaacggtaatggtacgcagatcacatggcgatccggcaactccggatcggcgaatatgccgtcacttgtgatggatgttcttggtaacgagtcggccgaccgtttgtggatctttaccgatgggggtctttctttcggattcgacaacggctgggatggtcgcaagctgactgaaaaaggtttgtcacaactttatgcgatgtctgacatcggtaatgataaattccaggttgcaggggttccggagttgaataacctgctgatcggcttcgatgcggataaggatggtcaatacacgttggagtttgctctttcggatcattttgcgaaaggggctgtttacctgcacgatcttcagtcaggagccaaacaccgtattacgaattctacgtcgtattcattcgatgccaagcggggagattccggggctcgtttccgcttgtcatatggatgtgatgagaacgtagatgattcgcatgtcgtgagtacaaatggccgtgaaattataattctgaatcaagatgctcttgactgcactgtaaccttattcacaatagaaggtaagcttcttcgccgcttgaaagtattagctggtcatagagaagtcatgaaagtgcagaccggaggggcctatattgtgcatcttcaaaatgctttcactaatgatgtgcataaggtgcttgttgagtat

SEQ ID NO: 88 - DNA, 1278 bp, Porphyromonas gingivalis
actatggaagtgaagaaaaacacagtggtgctacgccttctgatttggttcgtggccattcttctcttccactcctcacggctgtggggacaggaaggggaggggagtgcccgatacagattcaaaggattcgtggatacctaccatgccgtacgcagctcttctccttttgatttcatgagctcgcgtacgagagtgagaggtgagctggagaggtcgttcggtaattcgaaagtagccgtatcggtcaatgccacctacaatgctctactgaaagacgagaccggcttacgtttacgtgaagccttcttcgagcatcaggaagagcattgggggttgcgcctcggacgacagattgtcatttggggggctgccgacggtgtgcgcatcacggatctgatctccccgatggatatgaccgagtttctggcacaggattacgatgatattcgtatgccggtcaatgcattgcgtttctctgtcttcaacgaatcgatgaaagtggaagtcgtggtactgcctgtattcgaggggtaccgtctgcctgtggatcctcgcaatccttggaatatcttctccctttcgcccattgctcaggggatgaatatcgtctggaaagaagaagccggcaaaccggccttcaaggttgccaatatcgagtacggtgcgcgatggagcactacgctctccggtatcgacttcgctttggctgcattgcatacatggaacaagatgcccgtcatcgaagtacagggcattgtgccgacggaaatcatcgttagccctcgctattatcgtatgggatttgtcggcggcgacctctccgtacccgtcggacagtttgttttcaggggagaggctgcgttcaatatcgacaaacacttcacctataagagtcatgccgagcaagagggtttccaaacaatcaattggttggccggagccgattggtatgctcccggtgaatggatgatctcaggacaattctcaatggaaagcatattcaggtatagggatttcatctcccaaagacaacattctaccctgattactctcaatgtttccaagaaattcttcggcagtacactccaactttcggacttcacctactacgaccttacgggcaaaggatggttcagtcgctttgcagctgactatgccttgaacgatcagatacatctgatggccggatatgactggttcagtagtaagggcagcggtatattcgatcgctacaaagacaattccgaactctggttcaaagcccgctacagcttc

SEQ ID NO: 89 - DNA, 1392 bp, Porphyromonas gingivalis
tacggcaaaagaagaaagctcggaacctccgtccgaccttccgttctaacccaaatcagatttattttggacttacaccttattactgatttttttgaagggcttcgggtcaatcctatcggtgcagcagccatagtggctttcattatcgacctgcttcttctttgctgttcggcttttatgtcctcctgtgaggtggcttatttttcactaaagccgatcgatctgcagaacatccgcgaacggaatcactcttccgacatcgcgctttccaatttattagacaattcgaatcagctattagctactattctgatcgggaataatgtgattaatgtagccatcgttatcctttccaattatgccatcgagcagacattcgttttctcttctccgatcattggatttctgatccagacgatactcctgaccactgttcttttgctgttcggagagattctgccgaaagtgtatgcgcggaagaatccgctgcaatactcgcgcttttctgctgcagctatgtccgttatctataagatattgtcaccgttttcaaaattgctggtcaaaagtaccggcatcgttaccagaggtatcagcaagaagaaatacgatatgtccgtggatgagctctcgaaagcggtagccctcaccactacggagggagagccggaggagaaagaaatgattaacgaaatcatcaaattctataataagacagcctgcgaaatcatggttccgcgtatcgatattgtggatgtggatctgagctggccatttcgtaagatgcttgacttcgttgtttcgtcgggttattccagacttcccgtttcagaggggtcagaagacaatatcaaaggggtgatttacatcaaagatctaatcccacacatggataaaggcgatgaattcgactggcatcctctgattcgtaaagcatattttgtccccgaaaacaagcgcatagatgatttgctcgaggagttcagagccaataaggtgcatgtctccatcgttgtggatgagttcggtggcacttgcggactgatcacaatggaggacatattggaagagatcgtcggcgagattacggacgagtacgatgaggaagaactcccctttaaggttttgggggatggcagttatcttttcgaaggaaaaacgtctctctccgatgttcgacactatcttgaccttccggaaaatgctttcggtgaattgggggacgaggtagatacgctaagtgggctcttcttggaaatcaagcaggaactcccccatgtgggcgatacagcagtgtacgagccattccgctttcaagtgacccaaatggacaagcgccgaatcatcgaaatcaagattttccctttcgagcgcacttgggaggtcgaa

SEQ ID NO: 90 - DNA, 798 bp, Porphyromonas gingivalis
ataatttatagatcaacaatgaaactattactttatctcctattggtcttgtcgactctatccccgatgtattcgcaaatgctcttctcagagaatctcacaatgaatatagacagcaccaaaaccatacaaggaacgatattgcccgtactggatttcaaaaccgaaaaggaaaatgtgttcaccttcaaaaatactgccaatctcaatctgctgataaagcacggtcaagtaatcaacttaattaataagcttgagttttctacctatggcaataaagtaaccgtaagtggaggatatgtacacaccgaataccgctatttgttgcatcatgtttttgaggtttatccttatgtcgagtcgcaatgggcagaaagtagaggaatgaaatataaggtttctacgggattacagtcgcgttatcggctggtaaatagtgataactgtctcatgtttgcaacattgggggtatttttcgaattcgaaaagtgggaacagccagccactagcctctttgcaggaacgtatgcatacagccgaagtatcaaaagccacctgtctatcagtttcagacatcggttgggtgaacattgggaatttacaactacggctattcaccagggaaagcctgacagttattttaagaaggcacgttttggaggagctatcgacctcaaataccatatcacacctacgataggaatacgcggggcctatcggatcatctacgatactgcccctattgtacctgtgcggaaagattacaacaccgttgatgttggtatcgatatttcgttt

SEQ ID NO: 91 - DNA, 2721 bp, Porphyromonas gingivalis
actatatgcgttgccttcttatccgctcccgttgcggcattgcgcgagtcgccgccaatgggggcggagcggaagactccctctctcctaccccttcttttcgagcattctgataaaggaaaggggttcgactacagactattcacaagcaataaacttaaagtgtttgccacaggtaacagccgatacatacacaataaaccaacaatcatccaagcaatgaaacgaatcgttttatcatctttcctgttcgttctgtccatactttctttgatggcacagaacaataccctcgatgtacacatatccggtacgatcaaggatgcctcctccggcgaaccagtgccctatgccactgtaagcatccggctgacaggagcagataccacacaggtgttccgacaagtgactgacggcaacggctacttcgtcataggcctgccggcagctccctcctatcacctgacagcttcgttcgtaggtatgaaaacccataccatgcagattagtcggggaaatggacagcacgacatcaaatccatcgacatttctctcgaatccgaggacaaacaactctccaccgtcaccgtatcggcagcacgaccactggtgaagatggagatagaccgcctgtcctataatatgaaagatgaccccgcagccaagacgaacaacctgctcgaaatgctgcgcaacgttcctttggtaacggtggatggtcagggcaatatccaggtgaaaggatcttccaacttcaaaatccacctcaatggcaggccctcgaccatggtgagcagcaacccgaaggaggtctttcgctccattcctgcccatacgatcaaacgggtggaggtcatcaccgatccgggtgtaaagtacgatgcggaaggcacaagtgccatcctggacatcgtcacggaagaaggtaagaagctggaaggatattcaggttccatcacggccagtgtcagcaacaatcccacagccaacggtagtatctttctgacggcaaagtccggcaaagtcgggctgactaccaactataactactacggtggcaaaaacaagggctctcgctactttaccgaacgtactacatccatgctccaaacgatagaagaaggcaaagggcaagaaacctttggcggacacttcggcaatgccctcctctcattcgagatagattcgctcaatctctttacggtgggcggcaatgtacgcctttgggagatgaccaccgaccggaacagcgtagaaaaaagctttgccggcagcaacctcatgtcctacatagacagaaaactcaaaacacagatggatgccggatcatacgagctcaatgccgactatcagcacagcactcgcctgccgggcgaattgctcaccgtttcctaccgcttcactcacaatcctaataatagcgagaccttcattgaccaatggaagcgcgatccgctcaacacagctaatacgatccagtacgccggccagcactccaaatccgatgcgggcatggacgaacatacggcacaagtggactatacacgtcccttaggacaagcacattctttggaagcagggctgaagtacatctatcgtcatgccacgagcgatcctctctatgagatacgaccatccgaagatgctccgtggcagcccggctctctatatgcacagaatccgtcgaacggaaagttccgccacgatcaatacatcggagcagcctatgccggctacaactatcgtaaggatcagtattctttgcaaaccggcctccgagtggaaagcagcaggctgaaagcactctttcccgaaaacgcagcagcagatttctcccacaactcgttcgactgggtgccacagctcacgctcggctataccccctcgcccatgaagcagcttaagctggcctataacttccgaatccaacgtcctgcaatcggccaactgaatccctaccggctacagaccaacgattatcaagtacagtatggtaatcccgacctaaagtcggagaagcgtcaccacgtcggtctctcctataatcaatacggagccaaggtcatgcttacagcatcgctcgactacgacttctgcaacaacgccatccagaattacaccttctccgacccggccaatcccaatctgttccaccagacctatggcaatatcggacgagagcattctttcagcttgaatacctatgccatgtacacgccggccgtatgggtcaggattatgctcaacggaaatatcgatcgcacattccaaaagagcgaagcactcggcattgatgtcaattcatggtccggcatggtatactcaggcctgatgttcaccctgccgaaggattggactgtgaatctcttcggaggttattatcatgggggaagaagctaccagacgaagtatgatggcaatgtattcaacaatatcggtatagccaaacagcttttcgacaaaaaattgagagtctcgctgagcgcaaacaacattcatgcgaagtattcgacatggaagagccggaccatcggcaatggatttactatttattcggaaaatgccggtatacaacggagtgtttccctcagcctcacctacagcttcggtaagatgaatacacaagtgcgcaaggtagagcgtacgatcgtcaacgacgacctcaagcaaacctcatcccaaggacagcagggtggcggacaaggaaatcctaccggcaat

SEQ ID NO: 92 - DNA, 1350 bp, Porphyromonas gingivalis
tggtgccaatccgacccaatacctcattgccatgcagtatatcgaaacgctcaaggacatcaacaagggcgatcagaccaagaccgtttacctcccgttcgaggctaccggtatgctcggtgccttgggcggtatgaaggatttggtgaaaggatgagactctctgccattcttatcgctttgattgtgatgctgcctgctgtgcttagcgggcagcattattattccatggcgggagagcgactggagacggacagcattcgtccgaacgaactctcggcatcgatccgaagtgcgcttttctttcggaacaatgaatacaatgcacgttcggtcaaaggttatacgttgccgggtgcacgggtttccgcttttgcctcttactcgctgccggcagcacatggtgtgaagctttcgctcggagtatctaccctgaactactggggggcaagtcgctatccggccggtatcgcttattccgatttaccttattggacggactataacgactatgtacgcttgcgtatcctgccttatgtacaggccatgctgaagccgacggccacgactgctctcatgctgggcaatatagccggtggtacggctcacggactgatcgaaccgatctacaatcctgagttggatttgacggctgatcctgaagccggtgtgcaatttcggggtgattggacacgtttccgaatggatgtttgggtcaattggatgagcatgattttcaaaaatgacaatcatcaggagtcgtttgtctttggcttgtccactacttcgaaattgttatcgggtgaaggcaaatggcgactcgaactgcccttgcaggctattgccacgcatcgcggcggggaatacaactgggcgcagcaggataccgtgcatacatgggtcaatggagctgtcggacttaagctttcgtatcgccctcgtaccgacaaacccatgcagatttggggatctgcttatggtgtggcagccttgtcaagcggaggatacttcccttacgaaagagggtggggcggttatctttctctcggaatggacttggagcacttcgcttttcgtaccgactattggtacggcaggcattacgtttctccctttgctgcacctttcgccaattccctgacgtatgacaaacagcctcttacgaacggttggggcgattatattcgtctctatgccgactattcgtggcggatggcacgaagtgtttcgttggcggctgttgctcgggtatggttccagccttcggatcgttttgcgatgagccacgccttggaactgacgatgcgtatcgatcccaaattcccaatagcttttctgaaaggcaatcat

SEQ ID NO: 93 - DNA, 1341 bp, Porphyromonas gingivalis
ccgttttcaccgccatgggtatgtgctggagcggcttcctcagtacgcacacggccatgctcgacagtctcaagtaccgccgcctcatcacacaggcgatcggagcacatgcgatcggcggactcgtcgccggcatattcgcccattggctctttgtcctcatctcactcatttgattcgatacccgaccaacgtatgaacaaatcgctattatcattggcatgcctcatcctgtgcggtatgccggccatcgcccaacagacaggaccggccgaacgcagcggcgagccttctctggccgaacgtgtattcggtctggagcagaagcagaaaaagctgaaggtgtacttaggcatacagtcgttctacgaccagccgcttgtcgatgacgaatcccatatcggacacttcaaggtacaggagctgcggatgtctgctcatggcgaactgaaccgccacctcagcttcgactggcgacaacgtctcaaccgtgccgccgacggcacttcgtttgccgacaatctctccaatgccatcgacatcgcaggtgtggactggcacccgaacgacaaggtgtctttcttcttcggacgtcagtacgcgcgtttcggagggatagaatacgacatgaaccccgtagagatctaccagtacagcgaccttgtggattacatgacctgctatacttcgggcgtgaacttcgcatggaacttccaccccgaacagcagctgcagctacaggtactcaatgcttacaacaaccgcttcgccgaccgctaccacgtgacacccgatgtcgctaccgccacgagctacccgctcctctactcggcacagtggaacggtaccctcctcggaggagcactgcatatgcgttacgccgtgtcgatggctcatcaggcccaagagcgtaatatgtggtacttcactgcgggcaacctgttcaatccgggcaaacggatcaacggatacctcgacctcacctactcgatcgagggattggacgacaaaggcattatgactgctcgctacggcaagggcaagaccctcacggacgtcaagtactatgctctggtatcgaagtggaacttccgcattttcgatcaggtcaatctcttcctcaaaggcatgtacgagaacggctatgcgcctgcccaatacggcgagagcagccacacgcgccactcctacggctatatgggaggggtggaatattaccctacggagaccaacttccgtctgttcgtcacctacataggacggcattaccggtacagtgcgaccgagacggaaagcaccaatgctcttcgcgccggtctgatctatcagatacctttctta

SEQ ID NO: 94 - DNA, 681 bp, Porphyromonas gingivalis
  modified_base (282)..(282): n is a, c, g, or t
  modified_base (539)..(539): n is a, c, g, or t
tataagcaagctataatgaaacatttgtttaagtcgacattagtacttctttgtgctctttctttttccggtacctatacctttgcacaagaaaataatacagaaaagtcacgatttgatttttctgttaggctgggacagggatatattgcaggttcaactaccaacctgatgtatgggtatacatctgctaacgatagacttttgtctggtgcaatttatctgggcttgacaccaagtaagaaagaaaatgcaaccggcgtagcatttcgtttcttatcnccctctccgggttattatgtcgatatatccggcaaagaaaataccttgaattatgcgttttacgttgtcggagcatataatagaatagccattcctatacgccctatcaaaaattttaatttcatcttctctacagaagtcggaatggcttggatgagtcgtcatgagcaaatttacaattctacttcgcagacttgggataagcagcgcaagtcgaggtcgggactggattttggtctcgggatgcatctgcaatnccacattaataagaccgtttactttatggcaggaaccgatcttacgtcttgcatgttcggaaaaaggatcaatgactaccagcaaaaggatcgaaccttcattgcacttatcgacaacagtattggcataggattaaacctc

SEQ ID NO: 95 - DNA, 1218 bp, Porphyromonas gingivalis
atattcatagaccccgataagaatacaaaacaaaacgaacgaaatatgattatcaagaaaatgctgaaaaataaattggcccccttggccatactgttcctttttgctccaaaggctatgaaggctcaggagcaactgaatgtggtacacacctctgtgccatcgctgaatatcagtccggatgcacgtgcggccggtatgggggatataggtgtggcaacgacgccggatgcgtattcacagtattggaatccgagtaaatatgctttcatggatacgaaagccggtattagcttctcatatacaccctggctgtccaagctggtcaatgatattgccctgatgcagatgaccggtttctacaaattgggaacagacgagaatcaggctattagtgcttctctgcgttatttcacattaggaaagttggagactttcgacgaattgggcgaatccatgggagaggcccatcccaatgaatttgctgtcgatttgggctatagccgccagttgtcggagaacttctccatggctgttgcactgcgttacatccgctcagaccaaagcactcacaacaccggagagaatcaggccggaaatgcctttgcggcggatatagccggttatttgcagaagtatgtgctactgggtaatgcggagagcttgtggtcgttgggtttcaacgtaaagaatatcggaacgaagatctcctatgacggaggtgtcacgagttttttcatccctacttcgttgaatctcgggacggggctgttgtatccgatcgatgactataacagcatcaatttcaaccttgaacttagcaagctgcttgtacccactcctcctatcatggatcaaaacgatcaggccgggtatgaggctgcactcaagaaatatcaggaaacttcttcgatcagcggtatattctcttctttcggtgatgcgccgggaggactcaaggaagaattccgtgagattacatggggacttggggctgaatatagctatgacgataaattttttgttcgtgccggatattcatacctgcaccccaccaaaggcaatttgcagtacttcacggccggtgccggcttcaaaatgaacatattccgtatcgatgcttcctacctgttgtctacgatccagagtaatccgttggatcagactctgcggtttacgcttgctttcgatatggatggattgcgcaatttgttccac

SEQ ID NO: 96 - DNA, 1356 bp, Porphyromonas gingivalis
ctaataatcgaaaaggaaatgaaaacaacagttcaacaaattattctgtgcctggctttaatgatgtcaggtgtattgggcggaaacgcacagagcttttgggaagaaatagctcctccttttatcagtaatgagcctaacgtcaagtatataattcccaatatggggattgattcaaagggaacaatctatgtaaccgtgacaaaaaggattcagcagggagcaaattatacttctgagcaattgggtatgtactatcgaccattaggtgataatgaacagtggtggaaacatgatccgtattttgatgacaagatagttgcggatattcagacagatgcatatggcagagtttatgtatgtacgacttcttctcgagatcaagagtatcaactttatataaacgagcagaacgaatggaggtgtatattcaaaacttctgtgtctacatatgagcatggtatggctgtttttcgctcttcgacaggggtgacttatataggtaccaggcatcacatcttcgcatcaggtgtaaatgatttcgagttcaacactatctatgaagactctacacctatgagctgtcgctttgcagaggctacgaatagtggcaccatctatctggcattgatgcatgaaaccacaatgtctacgactatccttacttatcaaaacggtgagttcgtcgatatctcggaaagtgaattgagtaactcgattattgcatccatgtgctctaataaagaaggtgatataatagctcttgttacttcatatacaggatttatgagtggaacccttgcgatcagaaaagcagatgaaggcaaatggcaacttgttggcggagatatacagaatgcgatcgttcaaaatatatgcatgatggacgacaacaagattgcttgtgaagtcttcgggactcctaacggagtagatggtcggacaagggtttgtgtttctgacgcatctgtctttgattttgagtggtatgaagatgaaatatacggaggcctgatatttgacactttcttctatagcccttgggacaaacttctttatgcgaaatttggtgggattatgctcaggagtaaagagtcttttataacctctttcatttctccgacagttgtacaaggagtggatgtctatactttggccgggaagataaggatcgaaagtgaaactccggtgtctgaggtgttgcttttcgacctggctggcaggatggtacttcggcaaaccattgataataaaatctattcggacatagatactaacggactaaagcgaagcggtatttacgtagtctcggtgcggctctcttccggacaggtattcagtcataaggtgcaggta

SEQ ID NO: 97 - DNA, 993 bp, Porphyromonas gingivalis
ggcctgtacggtatgtctgttgtacctataataatttatctttgcggtatatcaaattatgcaagactcatgataatccggtgtcttatccgtcgtccgagaaccgtcctgttcgggttgatattcgtggtaggtcttttctctgcgatggcgcaagagaaaaaggatagtctctctacggttcagccagtgccgaatagcagcatggtggagcagacccctcttctctccattgatcaccccgtcctgcccgcttcttttcagaatacccgtacactgaaaaggtttagagacaaacatctttccgatgctttgctcaatggattgaagcctcatcgctcatctttgcaattgaatgaggaactcaacttcgcggcagagcgtcgggatttcgtttctcccctcttgcaaactcgccacgctgccggtgtcctttcatggcgaccgaccgataggatgcatttttatacatcgggcaatatcggtcttggccatgatttattgaccggtgtgcgcaaggacttcggatggaatgctggtgccgacttcttgctgagtcaaaatcttacggcacatgtccaaggcggttggcagcagaatttcggctttatacctatgacggctgtcaatggccaactgcgttggcaagccaccgagagattgagttttaccaccggtatcgattatcgacaggtacagtggaatgctttcgataatagaacgttctcgcttaaaggaagtgctcgatacgaagtgatggacaatgtctttgtcaatggatttggcagctatcctctctacagcagtacgcgctcaggactcaatatggctgttccgatgcatggattcggccctcagtacggtggatcgcttgagctgaaagtctccgagcgattcggctttgccgtcggtatggagcgcgaatacaatatctggactcgtcggtgggaaacgcattactttgcttatcctgtattctatggcgataagaag

SEQ ID NO: 98 - DNA, 987 bp, Porphyromonas gingivalis
gagacgaactcttgggtatccagcgattgcaattcgacgacgatgaaaacgaatagacgatacgcatttgttttgccgcttctgctactcaccggattgttggcatgggggcaggattcttcccacggtagcaatacagcgtttgcaactgattcttcgagtagagagttgcccacggagcagtccgcctaccgcattcattctgcctatatggtcggtggtggcggaagcataacgcgcgacacctatttgtcaccccttcgttatggaggatggacactgaatttgttgggagagaagacgttccctctcaaagcctccgattcccgttggatgatccgtaccgggcatgagctggattttgccctgatggacaatccggccaataatgctcatttctattccctgctgtataacggttccgctgcggctctttaccgccttggcgctaagcatctgcgagccgcgtggatggacaatctgcgcttggcattcggcccgggcttggaaatcgggcttggaggaatttatagtacacgcaacggcaataatcctgcgacattgaagctctacaccaatgccatcgcccaagcctcgataggatactacgtcccctccgaaacttttcccctgtattttcggttgctctcccagatcaatctcttcggtatagcctatggaaatggttttggtgagagctattacgagaattttttgctcaataacggcattgcaggctccctgcatttcacttatccgggcaagtttactcggttcacgacactcataacggcggatattcccattcggaacttctgtacgcttcgtgtcggttatcgctattcccatttgggctcttcgcttaacgcattggatactcgaatccacagtcatacggcttttatcggtttcgtcacggagttttaccgattccgtgggcgcaaagccatgaataccggtcggagaaccagtctttactatcatgat

SEQ ID NO: 99 - DNA, 957 bp, Porphyromonas gingivalis
tttacgtccggtacgatattcgtccgtatagccatatccggccgtgtagtgtgccgtgaggttgaggataacggaaggagagaagctgtgcgtcatgatggcatggtagtgacgctgctcgtaattgtcggtattgtggtagtagtgcggtactccttgcgcgtccacgtacataagaccggcactgttgtatcggcggccatatttggcttcatcctccttggaaagaccgttccatgcgatacccgtaacttcttttcctccgaaagtgatgaacctgagagccgtgttgctaccgaaatagcccacctgtgcgaaataggatttcagatccacgcttcctctatccacgtagccgtccgaaccgattttggacaggcgggcatccactgcccaatggcgaccgatgcgtccgctaccgagtttgaccgatcggcggaatgtgccgaacgaacctccgctcaaatcgacacggccataaggagccagtcccaaattatccgtacgcatattgacacttgccccaaaagctccggcaccattggtggaagtacccacacctcgctgcacctgaaggtcttcgatggaagaggcgaagtcgggcatattcacccaaaagacggactgagattcggagtcgttgaggggtactccattggtagttatgttgatgcgattggcatcggtgccacgcacgcgaaagccggaatatccgatacccgtaccggcatcgctggtggctaccacggagggagtcagcatcagcagataggggatgtcacgaccataattggacttggaaagttcggccttgcgaacgttggtgtaagcgacaggggttttcgccgtggcgcgagtagctacgacctgtacggtctggagctgcacattgctaagactatctatctcgctgttggagacgggtgcttgtgccgtcaggcagaaaggcaggacggc

SEQ ID NO: 100 - DNA, 1842 bp, Porphyromonas gingivalis
ccatataatgtccaatctattagcaacaagacgattaaaaaacaaatggaaaacttaaagaacattcagcccagagaggatttcaactgggaagagtttgaggccggtggcgtccatgctgccgtgagtcgtcaggagcaggaagctgcttatgacaaaacgctcaataccatcaaggaaaaggaagtggtaatgggtagggtaactgctatcaacaagcgtgaagtggttatcaatgtagggtacaaatcggaaggtgtggtacctgcaacagaattccgctacaatcccgaactcaaagtgggagacgaagtggaagtttatatcgagaatcaggaagataagaagggccagctcgtcttgtctcaccgcaagggtcgtgccgctcgctcttgggagcgcgtgaacgaggctctcgaaaaagacgaaatcgtaaagggctatgtgaagtgtcgtaccaagggtggtatgatcgtcgatgtattcggtatcgaggctttcctcccgggatcacagatcgacgtgcgccccattcgcgactacgatgcattcgttgagaagacgatggagttcaagattgtgaaaatcaatcaagaatataagaatgtagttgtttcccacaaggtgctcatcgaagcagagctcgaacaacagaagaaagaaatcatcggcaagctcgaaaaagggcaggtactcgaaggtatcgtcaagaatattacttcttacggagtatttatcgacctcggtggagtggatggtcttatccatatcactgacctttcatggggtcgtgtggctcatccggaagaaatcgtacagctggatcagaagatcaatgtcgttatcctcgactttgatgaagatcgcaagcgtatcgctctcggactcaaacagctgatgcctcatccttgggatgctctcgacagcgagcttaaggtaggcgataaggtgaagggtaaagttgtggtgatggcagattacggtgctttcgttgagattgcacagggcgttgagggtcttatccacgtaagcgaaatgtcatggacacagcacttgcgttctgctcaggacttcctgcatgtaggcgacgaagtggaagccgtgatcctgacgctcgaccgcgaagaacgcaaaatgtcgctcggtctgaagcaactcaagccggatccttgggctgatatcgaaactcgtttccctgtaggctctcgtcaccatgctcgtgttcgcaacttcaccaatttcggtgtattcgttgagatcgaagagggcgtagatggccttatccatatttccgacctttcttggacgaagaagatcaaacaccccagcgagtttacggaagtaggtgctgatatcgaagttcaggtaatcgagatcgacaaggaaaaccgtcgtctcagcttgggtcacaaacagttggaagagaatccttgggatgtattcgagacggtattcactgtaggatctatccacgaaggaacggtaatcgaagtgatggacaagggtgctgtcgtttctctgccttacggtgtggaaggttttgccactccgaagcacatggtgaaggaagatggctcacaggctgtactcgaagagaagttacctttcaaggttattgagttcaataaggatgccaagcgaatcattgtatctcatagccgtgtattcgaagatgagcagaaaatggctcagcgtgaagccaatgcagagcgtaaggctgaagccaaagcggctcagaaagaagctgctgccgaagctgccaatcctgcacaggctgtagagaaagccactctcggagacctcggcgagctggccgctttgaaagaaaagctttcagaaaac

SEQ ID NO: 101 - DNA, 729 bp, Porphyromonas gingivalis
tcgacaataatgaaaaaagctattctttccggagcggccttgctcctcggcctatgtgccaacgcacaaaacgtgcagttgcactacgatttcggtcattccatctacgacgaactagatggacgtcccaaactgactaccacagtggaaaacttcacacccgacaaatggggaagcaccttcttcttcatcgacatggattacacgggcaagggtatccagtcggcctattgggagatttcgcgcgaactgaagttttggcaagctcccgtttccattcatttggagtacaacggaggcctctccacaagctttactttcggacacgatgctctaatcggtgccacctacacctacaacaacccctcctttacacgtggatttacgatcacgcccatgtacaagcatctgggtgcgcacgacttccacacctatcagatcaccggcacttggtacatgcactttctggacggtctgcttaccttcaacggcttcctcgatctttggggtttcccccaagagaacccaatcgggggccctgtgctcaaagaaggggataagttcgtattcctgtccgaaccgcagttctggatcaacctcaatcgcatcaaaggcatcgacaaggatttcaatctcagcatagggacagagatggaaatcagcaggaacttcgctcgcatggacaaattctcctgcatccctactcttgcggtcaaatggactttcaac

SEQ ID NO: 102 - DNA, 705 bp, Porphyromonas gingivalis
atgaaaacaattagtaagaaccatgcggcacggatctgtgccgccattgctttgtttgcagtgtgtaacggccggatagctgctcaggattttctctatgaaataggaggaggttttggtgctgctcagtattttggcgatgcaaacagaggcttgttcggttcatccggagtaggtttggagttggtcggacgttacaattataattttcgctgggctttcagtaccatgttggattggcgtacattgagaggcgataccgataagtccgggaatgtcttccccgattttgctcaagcggattttaaggtcggcttgactcagctccacgttagaagcgaatttaactttctcccttatagcgatggctataagtatcttggtacagctcggctgtctccttatgtagcggccgggttgtctttgggttttgcttcgggtgctaaaggttcggcttttgctcccgggattactgcgggaatgggagtgaagtataagcttaaaccgcggatcaatgtcggtatcgagtattctttcacggggttacttaccgatgctttggatgcgctgacggataaaagtgtttggctcgaggatccatataagatcaatgactcctgggtcaaaaacaaggatgctacaggggccttagtgcttaggattacgtatgacttcggcctgcgtaagactttttgtaataaacaa

SEQ ID NO: 103 - DNA, 1308 bp, Porphyromonas gingivalis
aatataatgtataaagactataagggtttgtatgcgtcgcttcggtggtatgccctgatcattgggttgctatttgcagcagacggtatacaggctcagaacaacaactttaccgagtcgccttacactcgcttcggccttggccgtctcggagaacggacgactattagtgggcattccatgggaggactcggcgtcggtctgcgtcagggcacatacgtcaatgccgtcaatcctgcttcatactcggctgtggattcgatgacgtttatcttcgatttcggtgcatctaccggaattacgtggtatgccgagaacgggaaaaaggacaataggaaaatgggaaacattgagtatttcgccatgctttttcctatttccaaatccattgctatgagtgcgggagtgcttccttactccgcatccgggtaccagttcggatccgttgatcaagtggaaggaggcagcgtccagtacacccgtaaatacttggggacaggcaatctgaacgatctctatgtcggtataggtgcaaccccgttcaaaaacttctcaataggagccaatgcttcatccctttttgggcgattcacacacagcaggcaggtaatcttctccacggaggctccttacaatcccgtacatctctcgacgctgtacttgaaggctgccaagttcgacttcggtatgcagtatcaccttcttctcaaatcagatcgttcgctcgttatcggtgccgtctattctccgcgggtgaagatgcatagcgagctgactcagataaagaatcaggttcagaacggtgtagtagtggagagcgaaacccaagaatatatcaagggaatggactattataccctgcctcatacattggggataggtttttcttatgaaaagaaagataaacttctcttaggagcagacgtccaatatagtaaatggaaaggcgagaaattttataaatccgattgcaaattccaggacagaatacgggtatctctcggcggagagatcataccggatataaatgccgttgggatgtggcctaaagttcgctatcgcttcggtttacatggtgaaaattcttacctgaaagtgccgactaaaggcggtgtatatcaaggataccatatcgtaggtgctgtattcggtataggaatcccgctcaatgacagacgttcgttcgtaaatgtctctcttgaatatgaccgattgatcccgaaggagggtatgatcaaagaaaatgctctgaaattgaccttcggcctcacgttcaacgagtcatggtttaaaaagctgaaactgaac

SEQ ID NO: 104 - DNA, 2835 bp, Porphyromonas gingivalis
aataccatttcggagaatgggaacgatagcacctatttttcttttcaaacttttcttatgcgatcgatttatcaattactgttgtcaatactccttgcttctcttggtttcgtcgggctggaagcccaacaagccggagtagcaggtagagtattggacgaagaaggcaaccccatgattcaagccaacgtacagcttgtacagagtaccggccaagtagccgttgccgcaggtgccactaatgaaaaagggttgttcagcctgaaaacgtcacaggagggtgactacattctgcgcgtttcatatgtaggttacactacccacgacgaaaaaatatctcttagaaacgggcaaaccattacgctcaaagatatatccatgaacgaagatgcccgtcttctacagagtgtgacggtgcaggctaaagcggcagaggtcgtggtacgcaacgatacgctcgaattcaatgccggatcctataccgtagcacagggagcttctatcgaggaactgatcaagaagctacccggagcagagatcggatccgatgggaagatcaccatcaacggcaaggacattagcaagatccttgtcgatggcaaagagtttttctccaaagatccacaggtggcaataaagaatcttccggccgatatggtcaataaagtacaggtactgaacaaactgagcgagctgtcgcggatgagcggtttcgatgatggagaagaggagaccgtaatcaacctgacggtgaagcccgaaaaaaagaaaggcctcttcggaacgcttcaggccggctacggtaccgaccaacgctatatggccggagggaacgtcaatcggttcgatggaaataagcaatggacattgatcggtagtgcgaacaatacgaacaatatgggctttagcgagatggacagcgagatgggatccatgaccttcttctctccccaaggcggtggtcgacgcggcttcggcaatagtggaggtgttacgtcttcgtcgatgctgggcggcaacttcagtgtcgaattctcctctgcccttaatacaggaggcgatgcacgctacggatacaacgacaaggccatagagacgaccaaacgcgtggaaaatatcctcgccgaagggaatacttatatggacgaaaatatattggaacgctctttctctcacaatggtcaggcgcgatttaggatgcaatggaaaccgtccgaacgtaccgaagtggtattcgagccggatctttcgatatccaagatcgatgggttctttaacgacacatacgagacgaaagatgccaccggaatctctatcaacaaaggttctatccaccaaactacacaaggaaacaacttcagactgaacggagaattggatatcagtcacaagctcaacgacgaaggccgtacgatcagtgcctccgtcagtggcggtctgaccgacgaagacggagatggcatatatcaggctgtgctccaaagcgtggagacgaatcaaaagcaattcaacgacaactccaacctgcaatatcggcttcgcctctcgtatgtggaaccgttgggtaaaaactacttcgcacaagcgattctgaacagacgtttctcccgtcgcaattcggatcgtgaggtgtaccgactgggcgatgacgggcaatactccatattagacagtcagtacggactctcctacagtaacgagttcacccagtatcgcatcggactcaacctcaagaagattgccaaaacgtgggactacaccgtaggattcaatgtggatcccaacagaactgtcagctatcggagcgtagccggagtagagcaggacaaactggctttcaatcgtgtcaatctctccccgatgctccgaatcaactacaaaccgagcaggactaccaacctccgagtggactaccgaggacgcacgacacaaccatccatcaatcagatcgctcccgttcaggacatcacgaatccgctattcgtgacggaaggcaatcccggtctgaagccgagctattccaacaatgtgatggccatgttctcggacttcgatgccaaaagtcagcgagctttcaacattgttttcttcggcaactatacattcgacgacatcgtccccaatacgcactacgatccgtctacagggatccgtaccactcgttacgaaaacgcctccggtacgtggcaagcgaatcttcatgggacactatcgcttccactcaagaacagggcattttctttcaggatgtccttgttcaacaggttggccgaaggacaaagcttcatcaatgacgataagaacaaagctctctctttccgaacgagggaacgcctgacgctgacctatcgcaacaattggatcgatacgagtatcggtggcaatatcggattctatatggcgaataatagtctgagcggacagaaagattctcgcacatacgattttggcggcaattatcaagttgccctaacgcttccctatggattccgtatcgacagcgatgttgaatacaatacgaactccggttacagcggaggattcagtctggacgaatggctttggaatgcttcgctttcatacagcttcctccgtgacaaggccggtacactgcgtgtcaatggctatgacatcctcggtcagcggtcaagtatcagccgttctgcttcggccatcaatatagaagagagcatgtccaatacgatcggacgctacgtgatggtggactttatctaccgattcaacgccttcagtggtggtggatctcgcagcgatcatcagcgtggcaatatgaatcgtccgggcccacctttcggcggtggcagacgaccgtcc

SEQ ID NO: 105 - DNA, 1236 bp, Porphyromonas gingivalis
ggagagtatcctgcaaacagtaacgacaaaaaagagatggttatgaagctgattaaaagaagtttgctcctgcttggagcggtactgctgattacgcttcctgcgtactcgcagaatgatgacatcttcgaagatgacatctatacatcgcgaaaagaaatacgtaaacaaaaccaagttaaagactggcaaaaccaagaggacggatacggcgacgatacggaatatacagtggcttccgatcgggacattgacgcctacaatcgtagagatggccagtcctacgatgggaaaaagttgtccaaagacaagaaaagagactccactcgttcttctgttcccggtcgctatagtcgccgcttggctcgattctataagccgaatacgatcgtcatttcaggtgccgacaatgtatatgtaactgatgatggtgagtatttcgtctatggagacgaatactatgatgacgcgtcgtctgtaaacatttacatcaacagtccttggtgcgatccgttcccttatacgtcatggtatccatctttctccggctggtacaactatacgtggaactatccatggttctactacggtagccatatcggatggggcggttattaccccggatataattggtattggagctactactatgatcctttctacaatccctatggaatcggtatgggttggggatatccttatggctggggcagctattacggttggggtggctatccgggagtgatacatcactaccaccactaccccaagaagacctattccaatggtcagcattccggagcttactattcttatggccgaccgaatcgtatcaaaggtggaacgtccggtgccaaacttgggacaggacgctacgatagaattcaaaattcgtcttcgcaaaaaaataagttcggattgcagtcgaacaaacccaataataatctgcaaaatgtcaagtcgggacgtaccggccgagccaatagagaccgaaatatagaaacggtaactccaaacaacgggcaaaagcagaatcgtcccgtattccagcagaatcagtccggcaatgaccgaccgaccggacggaatatccgcagcgagagacagggggaaaataacgataggacattttcgactccttctcgtagcaatagtaacggtggcttctccacgccttctcgctcttcttccggctctatgagcggaggtggcggacgtagtggccggggacgcaat

SEQ ID NO: 106 - DNA, 1803 bp, Porphyromonas gingivalis
agtaatagcagctcccacaagtggttaatttattatcatatagaaaagactaaaagtattatgatccgcaagttgatcttactgcttgctctgatgccggtagcctctgtggcttttgcggtaccaacggacagcacggaatcgaaagacaatcgtatccttacaagcatgcaatcctcctctttgaatagggatgatgctccggataaatggcaacctatgcatgccaatttcagtattcagagcgatatgctgctttctactgcccaaaagtccaagaacacctggttcggcaactcctatatcatgggtataatcaagaacaattatctggagtttggtgcccgtttcgaggatctctataagcccctgcccggacatgaacccgagatggggcgtggcgttcctcacatgtatgtgaagggaagctatcattgggcggagctgactatgggagacttctacgatcagttcggtagcggtatggtattccgcacctatgaagagcgcaacctcggtatagacaacgcggttcgcggcggacgtatagtactcactccttttgatggagtgcgtgtcaagggtattgcaggacagcagcgtaactacttcgaccgcacgggcaaggtattcaattccggccgaggctacctactgggttctgatctggagctgaatgtagagcgttggagcagtgccatgcgcgacaatgactatcatttggctatcgggggatcgttcgtttccaaacacgaagcagacgaagatatatttgtgggtgtaggcgaagatcgcaagcgactcaacctgccgctcaatgtcccgattatgggcctgcgcaccaactttcaaaaaggaggtctcgccctctacgcagagtatggatacaaatacaacgatccctcggcagacaatgactatatctaccacgacggacaggctgcactcctctctgcctcatactccaaaaaagggatgagtatcctgttgcaggccaaacgttgtgagaactttgctttccgcagcaagcgaagtgcccagctcacaccgcttatgatcaactatatgccggcttttacccaagctcacacttatacgctggcggccatctacccctatgctactcagcctcagggagaatgggctttccaaggtgaactgcgttacaactttgctcgccggacagctctcggtggacgctacggtaccggcttgcgtatcaacgtttcgcatgtgcgtggtctggacaaaaagatgctcaaagagaatcccgacgaactgatcggaacggatggctacaccgtttctttcttcggcatgggcgacctctattattcggatatagatgtggagattactaaaaaggtaagcccaggattcaactttacgctcacctacttgaatcagatctacaataacaaggtactgcacggtgcagccggagagaagcctgagaagatctatgccaatatcttcgtctatgatggtaagtataagctgagtaataaggtagccctccgtaccgaactgcaatatttgcacacgaagcaggatcagggtgactggatctacggcatggccgagctctctatcctgccttctctgatgctttccctctcggagcagtataatatcggagagaccaagaaacattatgtcatggggtctgtcacctatactcacggagcacatcgagtagctttctctgcaggcaaaacccgtgcagggatgaactgctcgggaggtgtatgtcgtgtggtccctgagactcagggattctacctttcttatagcaccaatctg

SEQ ID NO: 107 - DNA, 756 bp, Porphyromonas gingivalis
agggggtcgagttcgggcatttcagcccgtggacgcgacatgcgttctttatttttgagcgcgttgcgcagctcctctctccatggttcagagcgacgcagtcggataagttcttctgtagtcatgtcaataaggcagaaaataaggttattccatctctcggtatgcgcccaaacgcatgatcatctcatcgaaatccacttggtgtgcatcgaattcggggccatcgacacagacgaatttcgtctgtcctcccacgcttatacgacaagccccacacataccggtgccatccaccataattgtattgagagaagctatggtcggtatctcgtaacgtttggtcaggagagaaacgaacttcatcatcacagccggcccgatcgtaacgcagaggtctaccgtttcccgtttgataacgctttccactccatccgttacgaggcctttcgtcccataagacccatcgtctgtcatgatgatcacttcatcgctattggctcgcatttgttcttcaaggataaccagatctttagttctggcagccaatacgacaattacacggttgcctgctttgtggaaagcctccacgatcgggagcaaaggagccacacccacaccgcctccggcacaaaccactgtgccgaccttttcgatatgcgtactctgtcccagcggacctaccacatccgtgatatagtcgccgacttcgagttcggccaatttcttggaagatttgcccacggcctgaaccac

SEQ ID NO: 108 - DNA, 2370 bp, Porphyromonas gingivalis
ctcttgttttcttctcctttaccccgaatggatcgtcctaagccttcatatattgttcgaatagcagccattctctgcttgtttgtcggcaggcctttgtttgcgcagagctatgtggactacgtcgatccgctgatcgggacgctaagttcttttgagctgagtgcgggcaatacctatccggtgatcggtttaccgtggggaatgaatagctggacaccgatgaccggtgtacccggtgacggctggcaatatacctactcggcacacaagattcgcggattcaaacagacccaccaacccagtccttggatcaacgactacggccaattctcccttcttccccttacggcaccgcagaagccatcatcgaacgactccatagctctgactaaatggtgcaagcaactcttttcggacgaacagacctcgtggttctcgcacaaagcggagacggcgacgccatactattatagtgtctatttggccgattacgacacacgcgtggagatggctccgaccgagcgtgcagctatctttcgcatacgttattccggcaataccgaaagtggctccggtcgatggcttcgtcttgatgcctttaccggtggttcggagattagcatcgtggatcctcacaccgtagtgggcatatctcgcaagaatagcggaggtgtgccggctaacttcgcctgttatttcatcctgcagtccgatactcctatggccgatgtcctgcttgagacagataccggcaagtcagacgaaggcacaagggcatgggcagcctgtcgcttcgattcgcaagaagttaccgtccgggtggcatcttcttttatcagtgtcgagcaggccgaaagaaatcttgcggaagtcaaagggcagagtttcgaccggatcagacttgccggtcgcgaagcttggaataaggtgctcggacgcatacatgtggaaggaggaacgaaggatgagcgcactacattctattccgcactctatcgctgtctgctttttccccgtcgcttctatgaggaggatgcttccggcaattttgtgcattacagcccctacaatggagaggtacttcccggttatctctataccgataccggattttgggacacttttcgagcccttttccccctgctcaatctgctgtatcccgatgaaaacattaaaattcaggaaggtctgctgaatgtatatcgcgagagtggctttttccccgaatgggccagtccgggccatcgggattgtatgataggcaacaactctgcttctgttctggcggatgcctacctcaagggtgttcgggtagaagatacccgtacactgatgaacggactcttgcatgctacgaaagccgtccatccgaaaatctcctccacgggtcgcaaaggttgggagtggtacaactccttaggttatgttccggctgatgcaggcatcgacgaaagtgctgcccgtacgctcgaatatgcttataacgattggtgcatcctccgactggggcgcacattgggttgggatagagctgcattggacacgttggctcatcgttcgatgaactatcgtcatctgttcgatccggaaaccaaactcatgcgcggtagaaatcaggatggtagtttccggacacctttttcccctttcaaatggggagatgtattcacggagggcaatgcctggcactacacttggtcggtctttcatgatgtgcaggggcttatcgacctgatgggaggagatcgcccgttcgtgtctatgctcgattcggtattcaatactcctcctatgttcgatgagagctattacggatttgtcatccacgaaatcagagagatgcaaatagcggatatgggcaattatgctcatggcaatcaacccatacagcatatgatatatctgtataatcatgccggtcatccatggaaagctcaggagagactacgcgaagtgatggggcggctctatcgtcctactccggatgggtattgcggcgatgaagacaacggacagacttcggcttggtacgttttctctgctttaggcttctatcctgttacacccgctacggatcagtatgtgctcggttcgccgattttttccaaggtaatactctcttttcccgacggacacaaaacggtgttgcatgctccggccaacagtgccgatacgccttacatccgctcgatcagcgtagaaggaaaagaatggagctgcaattacctgactcacgaacagcttcgctcttctgcatccattcaatggatgatggacacgaaacccaattataatcgtggtatgaaggaaagtgacagaccttattccttctccacggagcaacagcgtcgcgctaatcacagtaat

SEQ ID NO: 109 - DNA, 858 bp, Porphyromonas gingivalis
atttgtggcagtaaaatgaatctatcgggattacaatctttcactatgatgaaatccatgcgcagcgtgctgttgctactctttccattgtctttgatcactgctttgggctgtagcaataacaaagctgccgaatcgaagtctgtctctttcgattcggcctatctcgaacgctacatccctctgcgggcagacatagatacgccatcgctgcatgtgatgatcagctacgtctatccttcgggagatgatatgctcacagagattttcaacggtttgctcttcggcgacagcctgatggattcctcttcgccggagaatgccatggaaggctatgcacagatgctgggagaagactatcgctctaacaatgccgaagccaatctgcaagggcttccttctgaccttttggactatatctacaagcaggaaaataccatcgcttattgcgatacgggattgatctccacgcgcatcaatacatatacttacgaaggcggtgcacatacggagaatacagtccggtttgccaacatccttcgcaccaccggcaaggtgctcgaagagcgagatatattcaagatcgactatgcggaaaggctgtccgcactcatcataggacaattggtgcacgatttcggcaagaccacacctgccgaattggatgcaataggtttcttcaacgcagaagaaatacagcccaatggcaattttatgatcgatgacaaaggtctcacatactgtttcaatgagtatcagatagctgcttatgccagaggtgctgtctatgtccgtctcggatatgacgtattggctcctttgctaagggatgattccccactaaagcgttacttgccg

SEQ ID NO: 110 - DNA, 1134 bp, Porphyromonas gingivalis
gggataatatctgttctttcacatgtggttgaccgtccacaatggggtgcttctcccgaagctgctggcacgcatagtgtgtattcgattctacatccctccgccggtattatccggatcaggtctatgggtattatctcagcctgccgtatcgcaattcttgccggcaagcacccccgtagcggtctgtcgagggcaaatgtaggtattctttcgtacaatccagaaaacacgcccgagaaaaagagaaaactgcaagaaaaaaatgttttcctccaaatccggctccgtcaatcatttaataatttgataccttcgctcccatttagaatcgataacacaaaaaaaatcactgaaatgaaaaaaactactttgacaggatcgatatgtgctttactcctgtttttgggtctctcggccaatgcccaatcgaagttaaagatcaagagcattgaggcagctaccactttcagttcggccacggccggaaatggttttggtggcaatatcttcggcatggacatgagcatacggatgagggtacaccacagcattctgcccgaagggttggatttttcggtaggaatacatgaaagaagagcacactgggaagaggccggaagtccgaagctcatgtatacgaatgtcccaagtatcattggtattgttgaaaaggtaatagtcttcgaagacgcagaagacttttttgacaaaaaagctctcggccgcttcctcatcagtttggggatatcctataccaagcatctgggagcgtattggggatggaccaatgacgcccatattcttttctcaccgatacccaagagcaaggtccactatgacacctacacaagagctggcagtgaccttgtacttcagtccgaagatgttgccacagtgagcaatggcttttcaccggggatcggactcaaaagttctatttggtggaaaatgcccatcaagagcaaatatgattttcgcctcggtttcagcctgggctatgagtatctgaacctgctatatccgtatcgtaatttcaagctggatggaaataagccgctttcagcactatctcctcgcatgaaccacatcggccatgtgggcttcaactttaccgtgggtctttggactaat

SEQ ID NO: 111 - DNA, 3807 bp, Porphyromonas gingivalis
gtaaaatgtatgggcaagtataaaagagctaagtaccgctattggctttttcctttctgttcggattattatacctttgagggagttacttttttatgcgcatctgacgatatgacaaccaagaaaccccaagccattttagacttagagaaggcctataacattgaaattcctgatctctcctcacaagaagggataagctggtcggtaaatagatatttcaagcaagattcctccggtgcagtcgttgagctttgcttgcgagaatgtcagatagaaagcatgacttggcttattgattttcctgctctaaaaaagcttgatctatcgtataaccaaatcagtaagctagagggtctagaacgtcttacttcgttaacaaaacttcgtctaagaagtaaccaaatccgtaaactagagggcctggatagtctcacctcgctaacaaaactttctctctccgataaccaaatcagtaagctagagggtctggaacgtctcacctcgttagcggagctttatcttttggataaccaaatcagtaaactagagggtctggaacgtctcacgtccttagcaacgcttgaactatcgggtaaccaaatccgtaagctggagggtctggaacgtctcacgtccttagcaacgcttgaactatcgggtaaccaaatccgtaagctagagggtctggaacgtctcacttcgttaacaaagcttcgtctaagaagtaaccaaatcagtaagctagagggtctggaacgtctcacgtccttagcaacgcttgaactatcgggtaaccaaatccgtaagctggagggtctggaacgtctcacgtccttagcaacgcttgaactgtcgggtaaccaaatcagtaagctagagggtctggaacgtctctcttcgttaacaaagcttcgtctaagaagtaaccagatcagtaaactagagggcctggaacgtctcacctcgctaacaaaactttctctctccgataaccaaatcagtaagctagagggtctggaacgtctcacctcgttagcggagctttatcttttggataaccaaatccgtaagctggagggcctggaacgtctcacctcgttaacaaagcttcgtctaagaagtaaccaaatcagtaaactagagggcctggatagtctcacctcgctaacaaaactttctctctccgataaccaaatcagtaaactagagggcctggaacgtctcacgtccttagcggagctttatcttttggataaccaaatccgtaagctggagggtcttgatggtcttgcttccttaacaaggcttagtctaaggcgcaaccaaatcagtaagctggaaggactagacagactaaaggttttgagaaaacttgatgtttcgggcaatgatattcaatctattgatgatattaagctattggctccgattctggagcaaactttagaaaaactgagaatccatgacaatccatttgttgcatcatcaggcttgatactctctccttatgataatcatttgccggagattaaagctcttcttgaaaaagaaaaagaaaaacagaaaaagacttcagttgaatatcacccattttgcaaagtaatgctattgggaaatcattcttcgggtaaaacaacatttcttagtcaatacgatacaaattatacgtatcagaaaaatacacatgtgttgtcgatacatcgaagcaataaccctaatgcgatcttttacgactttgggggacaggactattatcatgggatttaccaagccttttttaccacccaatcgttataccttctcttttgggatgctaagaaggatcgaaactttgtgagcgtagatgataaagaatatcagactcttaatttcaatcgcccctattggttaggacagatagcctatgcctgcaatcgttgtatgtccgttggaggaaatcctgatggcaaggacacaccacagaccacagacgatacaattatcattcagactcatgccgatgaaacgggcgctaagcagcaaaccttaggctgtgcagccgagaatggagtattggaagaaatctatgtatccttagagcccaaggcgaatagtgccgtacatgcgctcaactatctgaatgagcgggtgcgagaagttgtcgcaagcaggagtaaatcaattcagatcacagaaaaagataagggattgtacgaagctcttcccacaatcgccggtgataataaacacatccctatctctctcgaagctcttgcggctcaattgaataagggaagagctgaaaatgatctttacaccatagagtatctacagaccgaattgaaccagcttagtctgcgaggggaggtgctttactatcgtgagaatgagaagctgaacaattatgtctggttagatccggcagcttttgtccaaatgattcatggagaaatcctccaaaaagacaacatcaatagaggaacagttcctaaagacatttttgaatgcaaactgcataatctaagttccggaagtatatttgaagaagatggccaaaatggtaatatgatcttgcagctattattggaagagctgatcgtatatgaagataaggactgctatgtgataccgggctatctccctttgcattccgatgacgaagcctataaatggcttactttgggattcgagaggcccaattttgtcctcaaattcgaacgttttatcccctttggcctgatcaaccagattatagcctactatggccgggaagaaggtgctctaaagcggtattggcgagatcaggtcatcttcacagcaggccgtgagatggataggcaaacgcttgagcaagaagaagagaaagagggtttgcccaagacgaatgccgaggattatcagatctggatcaagctcgactttaccgacttggccatatccgtattcatcaaagagcagagaaagacatcagctaaggatatgcagcggaaagaggctactatcctcagtgatatgttggatatgtattggaacaatatccctccgagggagcaaataggagataaggatacggagcaaacgagaagcactattcgtgaaacaaacagaaagaagagacccatccaggatctctacctctcctgtgcccaagcggataaagatttgacggagtctcattatatccatttgggcacgctggacgatgaaagcaagactacggcgaggattgcagcctatccgttgaagaacggcgttatcgataaagagcgggtgcgagaagtatcgactcgtccctacaaacatctttccgtcaataaaaatctggctactgcaaaacagatctttatttcctattccaaagaggatcagactgaactggagacctgtctgcaatttttcaaacccttggagaagaatggtcagatcgagatctactatgataagttgactaagtttgaaacacctattcaccctgaaataagaaagcgtattgtcgaagccgactgtataatcgctttgatcagccaacgctatctggccacggattacatcctggatcatgagttgcctgtatttcgggagtataacaagaccatagtgccgatattgatcaagccttgtacattcgaagacgatgagttccttcgggagaaatattttgctcagaaagctcaaataatcaatcttggaaaagagggaaaaaccattaaagcttatgatagtattacggcatcagcccatcgtgatgaaaattgggtggcagtagtcagagagttcaaagagaagatattaagaataacaaaacaggaggtaaatacagatgaa

SEQ ID NO: 112 - DNA, 693 bp, Porphyromonas gingivalis
aagtttatgatgaaaaaagcatttgttttcgtactactggtttgcctattctcctcgttcagcagttccgcccaaacaacgacgaacagtagccggagttattttacaggacgaatcgagaaggtgagtttgaacttaggggtcccccccgtaagcacagaggtttggggaatgacccatgatgcgaacggtctccctttcgaaatacctatctctttcagtcgtttcaacagccagggagatatagctaccacttattacatagcgaatagcgaggcaactttgaatgaatggtgcgactatgcacacccgggcggcatcgtgagggtagaaggtcgtttttggaaaatgacttacaacataccaacctacaatgcagtctgcacccggattacattcgaaaatcaagaaatagaaggaacgatcgtcttgatacccaagcccaaagtctcgctgcctcatgtgtcggaatcggtgccttgcatccgaaccgaagccgggagggaatttatcctttgcgaagaagacgacacctttgtgtctcacgatggtaacgaagtaacgataggcggtaaacctttcttgctcaataccaacgtaaagattgtgggggacgtatctcaaaagtatgccgtgggggtaggagaaattcgattcctgcagatttgtgcccaaacagtatcacaacaaaaa

SEQ ID NO: 113 - DNA, 1689 bp, Porphyromonas gingivalis
tcgctaatcaacaattcaagagactggagggctcctgtccgattgagtctcaaaaaaaagacaaaaactatgaagacaaaagttttacgcaaattcgtggtggcggctttcgccgtcgcaaccctctgtcctctcgcccaagcgcagacgatgggaggagatgatgtcaaggtggtccagtacaatcaggaaaaactggtacaaacgaggatgagtgtggcggacaacggatggatctatgtaatgacccacagtggatacgacaccggcaatagcaatgtgaagatcttccgctccaaagaccaaggtgccacataccaaaagttgagggattgggatccatcggatgattatcagtttcaagacttcgatatcgtggtaacgggtaagaatgaatccgacatcaagatttggtcggtagagctcatgaataagcccggaggatataagagtagagttgcggtcttcagtcgcgatgccaacgcgcagaatgcgaaactcgtgtataaggaagacttctccaatgtgcagttgtacgatgtggatatagcctccaactatcgttcgccttcttctcttaacaatggtggcaacccttttgctttggctttcgcttacaccggcttcaacaatacgcacaaaataagttttgtggactatgtgttctctctgaatggagggcaaaatttcaataaaaacttactcttcagtcaagatggagagaagaaaattgacaaggtggatctctcattgggtagcacctctgaatccatgggtcacaatgcctggccgctaatgggtgtggtattcgaaatgaataaacaagggggaaaaagcgatatcggtttcttgtcgaactttgtcgacaatgatcccgaatttcagtggtcaggccctataaaagtgagtgaaagcgacatgtcgttcagccccaaaatccaaatgttgctggacgaggataacaatacgatcaatggggagagttgccacaacttcatgattacgtacagcgattatgattctgaatattcggattgggacattcggtatgtatatcccaagaaatcgttcaagtatgaaaaaggaaaaactccgactatggatgatctggtggaagctttccttacagcttcgtaccagagtgagaccaactcggggctggggtatgacaagaacgccaatcactacctgattacatatgccaaaaaagaagagaacggtacgaacacgctgaaataccgctgggccaattatgacaagattcataacaaagatttgtggagcgacacatttacgtatacatcatctgccaatgctctctacacacctcaagtagacatcaatccgaccaagggtctcgtgtgctggtcatgggtggaatatctgccgggcaaacggatcgtttggtctgatacgcagtggacccatgccaacggtgtagaagacatcgtaatgcaagaaggcagcatgaagctctacccgaatccggctcaagaatatgctgtgattagcctgccgacggcagcaaactgcaaggctgttgtttacgatatgcagggcagagtagtcgctgaggcttctttctccggcaacgaatacaggctgaacgtgcagcacttggctaagggtacgtacatactcaaggtcgtatccgatacggagcgtttcgtagagaagctcatcgtggaa

SEQ ID NO: 114 - DNA, 2358 bp, Porphyromonas gingivalis
atcgtttacctttgtcactgtatgaaccacagacgatcaaaaaccatgctgacgatccgaaacttcctcctcttttgttgtctgtcgctgatagcgtttgctgccgatgcacaaagctctgtctcttcgggtagacgactgacagaatatgtcaatccctttatcggaacggccaattacggtaccacgaatccgggagcagtattgcccaatgggttgatgagcgttacccctttcaatgtcagcggatcgacagagaatcgcttcgacaaagattcgcgttggtggagtgcgccttattcggccgacaatagttactgcatcggtttcagccatgtgaatctgagtggagtaggctgtcccgaactgagtggaatactgctgatggccacttccggcacattcgatcctgattactgctgctatggctcttcgctcagtcgagaatatgcgcgcccgggagaatacaaggctgtattggacaaatacggtatagatgcagccgtgaccgtaaccgagcggactgctttgaccgaatttgcttttcccgaaggagaaggccatatcctgctgaacctgggacaggccctaagcaatgaatcgggagcctctgttcgattcttaaacgactccacagtcgtcggcagcaggctgatggggacgttctgctacaatccgcaagcagtttttcgtcagtatttcgtacttcaggtgagtcggcgaccgatctctgccggctattggaagaagcagcctcctatgacagtggaagcccaatgggattcgactgcagggaaatataagcagtacgacggctacaagcgtgagatgagcggtgatgacatcggtgtccgattctcgttcaactgcgatcagggggaaaagatctatgtacgatcggccgtttcattcgtcagcgaagccaatgcgctctataatctggaagcggagcaagaagaggtgttcaaaagtgtcggagggaatccggccaaggctttctccgctatacgctctcgcgctatagagcgttgggaggaagccctcggtacggtggaagtggaaggaggcacaccggatgaaaagacgatattctataccgcactctatcacctgctgatacatccgaatatcctacaagatgccaatggagaatatcctatgatgggcagtggcaaaacgggtaatacggctcacgaccgctacaccgtgttctctctttgggacacgtaccgcaatgtacacccgctgctctgcctcctctatccggagaagcagttggatatggtacggacactgatcgacatgtaccgagagagcgggtggctgccgagatgggagctgtacggacaggagaccctgacgatggagggcgacccctcgcttatcgtcatcaatgacacttggcaaaggggccttcgtgctttcgatacggcaacggcctatgaagccatgaaaaaaaatgcttcttcggcaggagcgacccatccgatccgtcctgacaacgacgactatctcaccctcggcttcgtaccgcttcgcgaacagtacgacaattccgtatcgcatgcgctggaatactatctggccgactggaatctgtcccggtttgcccacgcacttgggcataaagaagacgcagctctattcggaaaacgctcgttgggctacagacactattataataaggagtatggtatgctgtgtccattgctgccggatggatcattcctcactcctttcgatcccaaacagggtgaaaacttcgagcctaatcccggtttccacgagggcagtgcttataactatgcctttttcgttccccacgatatacaagggcttgcccggctgatgggaggagcaaaggttttttcggaaaggttgcagaaagtcttcgatgaaggatattatgatccgaccaacgagccggacatcgcctatccttacctcttctcctatttccccaaggaagcatggcgaacgcagaaattgacccgggagttgatagacaaacatttttgcaatgctcctaacggcttgcccggtaatgacgatgccggtacgatgagtgcttggcttgtctattccatgctgggattctaccctgactgtccgggcagccccacctatacactgacctcgccggtattcccccgagttaggattcggctcaatccgcagtattatcctcagggggagttgatcattacgaccaatacagagaatcaaccgacagattccatttacatccatacggtttctcttggcaataaaacacttccgcatggaacaaggcatatcagccatgccgatttggtgcgctgcggtcacctccgttacgaactaagcaatcgtcctcga

SEQ ID NO: 115 - DNA, 2442 bp, Porphyromonas gingivalis
ccccgttttcatcccggagggacacacgctcagctttgcagaaatgggagaagaaaccaaaaatcaaatcagtcatcgtgctttggcggtggcacagctccgcgattttttattatgtgcaaaataagattcagcctcttgcaggctcttgtcgtctgcttattgttcacctctttttctctccaagctcaagaggaaggtatttggaataccctcttggctatccacaagacggaaaaagccgtagaaacgcccaagaaagtctttgccgtagccaacggagtactttactcggtgggcaaagaagctccccatgaggcaaagatcttcgaccgtatcagcggactcagcgatacatcggtaagcagcatagcctactccgagcaactaaaatccttggtcatatactatgcatcaggcaatatcgacatcttggacgaagcaggccgtgtgaccaacgtacctgcattgaaagacaatatcgatctgatagacaaaacgctcaatcgccttttgatcgtaggcaacagggcttatttggcaggaggattcggcctctccgttctggatgtcgccgaagctcgcataccggctacctacgccaagggaactaaggtgaccgatgtggctaagttggacaatgatcgcttgctgatgctgaaagaagggcagctcttcatcggaaaagagaccgataacctgcaagatccggccgcatggacagccttgtctttgaatttgccgatgggctcggtcaccggtctgggcattgtcggggaagacatctgtttcctgctcgccgatggccgtgtatatgtcgctgcaaaccaatcgtttgagccggagctattgctctcttcctccgccgattcacgactgtatgtgacggatcgtggtctgttcatctgtgccgagaatcgaatttatttcatagaaaaaggtcgcaaaacgacacaatttcctatagccgacgtccttggtgtcggtgccatgaacgaaagcaatacggcatacatagcattgggagaagaaggtttggcttcacttcttctcgcagagggaagtacggccgaagccatgcctgtagcattcgacggaccgggggacaatgatttctacgagatgcggtttagtcacggacgtctgtatgcagccagcggactctggggaacaaacctgatgggacatgccggtatggtgaagctatacgacggcaaccgatggactaacttcgacaagaagaccgtacaggaacagttgggcggcggattcagtttcaatgatgctatcgatatagctgtttccaacggagaccccgatcacttttttgtcggtacatggggaaacggtctgttcgaattcaaggatggcaaagcgatagctcgctattcgggaaacgaaactgctatcgcagaatgtaatcccggagatgcccgtgtgaaagcgattgcctttgacaataagggcaacctctgggggacgctcggtgccgtaggcaagaacatcttcatgtacgatccgcagagtagcacatggcattctttcagctatccggatgtagccaatctggcctccttcggcaatatgattatcctacccaacggagacaaatgggtaaatatccttcaccgtagtggcggatccacgcgcaaaggtgtcttgatcttcaacgatcggggtacaccggaaacgacttcggacgacagccatctttacgtcgagcagtttgtcaatcgcctcggggcagccataggacataagactatctatgcaatggccgtcgatcataacggctctgtctggatgggatcggatataggcattttcggcgtctacaatgcagccggagtattgtcctcgacttctacccctatcgctgttcggccggtcggaggagaagaacccaatttgtactatgtgctggacaaggtgacggtgacagacatcgtcgtggacaaactcaatcacaaatgggttgccacccaagggacaggactctatctcctttcggaagattgcagtaagatcctcgcgcaatttaccgtagaaaacagccctttgctttctaacaacatactatccctggccttaaatgacgataacggactgctgtacatcggtacggcggacggactgatgacgttccaaacgggtacggggagtggatcagcttccgaactggacggcgtctatgtataccccaatccgctaaggccggaatatcccgatggcgtcaccattgccggactgcaagccggctgtagtgtcaaaatcaccgataccaccggcagactgctataccagactgagagcgtaaccaccgaagtcaaatggaatgctcgaggtgccgatggcaatagggtagcttcgggcgtatatgccgttgcagtgtacgatccggtatcgaaaaagtccaaactaattcgcttcgcagtgattcgc

SEQ ID NO: 116 - DNA, 3486 bp, Porphyromonas gingivalis
gctatttctcagatgaaacgaatacttccaatagtcgcattcctttctctcttccttgcccttgctttgcctgcgaaagcgcaacgagctatggggaagacggccgaccgttcgctaatggcttcgggacattgggtcaagatacgtgtcgatgcaagtggagtgtatcgccttacggacgaacagctccgtgccaatggcttctccgatccgtccaaggtaggtgtgttcggttatggtggaggggtgcttcccgaagatctgagccggatcacgacagacgatttgcctccggtaccggtactccgtcagggcaatgcgctgtatttctatgccgtgggcccggtgacatggttctacaatccggccaaaaccaccatggagcatacggtgaatacatacagtacgcatggctactacttcctgtcggatgctgccggagcacctttgcagatgtcccaatatacgggtggaggtgcgtcggccgaggctttgatcgactactacgatgagctgatgctccatgaacaggaattgtattcgcccaaagaatcgggacgagatctgtatggcgagtctttcagtgcagtcaatacgcgtacggtcaagttccctttgaggggcaacacccgctcgtctggcgaactcggtaccgtattctcatacatagccaaggccagatcggccggtggcggccgtgagatgtcgctctcggcgaatggcattctgatcttcagcgatcctttttccatgacatcgaatgaagtctccaattcctatttggccggcaagaagcgtcgtctctatcacagtacgccgatgaacagcttggtcaatgagttgcgcttggacgcgaactatagcatgacaggagatgcggtcaatctggatttcatagaggtggctacacagaacgacctccggtacgatggcgcacccatgcatatcaggcggttttccaatttgcccgttttggggggcgagtcctgccggttcgttatcagtgaggtgccggagtctctggtggttttgcaggccaattcttccctgacagcatcgcttgttcccgttaagactgtcggggataagaccattgagttcgtggctccgccgaagggtcaggatcgtaggactatcaatacgttttatgccgtggacttgtcacaggcttctgctccggagatcctcggagcggtacccaatcaaaacctgcatggagaggaaatccctgatctgatcattgtctctactcaggcgctcctccttgaggctgatcgactggccacctatcgtagagagaaaaacgggctgaaggttttggtcgtgttgcaggaacaggtgttcaacgagttttcgggtggaactcccgatgctacagcataccgcctctttgccaaaatgttctacgacagatggaaggcaaatgcacctgtgggagagaccttcccgatgcaaatgcttctcttcggtgatggggctcatgacaacaggaaggtctccgtagcttggcagaaaccgtatctccaacaaacggagttcttgctgacattccaagccgtcaattcgacgaacgtaaacagttatgtgacggatgattacttcggcttgctggatgatcagccggcctcggtcaatatcggttggcgcaattataatatggctgtagggcgattccccgtacgtactccggccgaagctcgcatcgcagtggacaagaccatccgatatgaggaggatcgagagagtggtgcctggcgtattcgtgcctgttttgcggcagacaacggggacaagcacgcaaccgagacttcccgtttgatcgataccgtcaagcgttatgctcctgccatcatgccggtacgcgcctttcaggacgtatatccgcatgtcatcgagaacgggttgcacagcattccgggtgcaaagaaaaagatgctggaaacccttcagtcgggtattatcctgcttaattatgctggtcatggcggtcctgccggatggtcggacgagcatttgctgacgctcaacgatatacacaaattcaattataagcatatgcccatttggattactgccacgtgcgactttgccaactatgacagtcagacgacctcggcaggggaggaggttttcctccatgagaagagtggcactccgatcatgttctcgactacgcgtgtcgtttacaatacgcagaatgagaagatcaatggttttatgcttcggcgtatgttcgagaaagctaaggatgggcgttatcgtacgatgggcgagattatccgatcggccaaacaggggatgctcagtactgttttccccgattcgatcaaccagttgagtttctttctgatgggtgatccgtccgtgcgtatgaatcttcctacccacaaagtgcaattgaccgcaatcaacgggcaggatcccgaagggcagtatggaactattatgctcaagtctttggaacgggtagctctgaagggtaaggtaaccgatgaaaaggggacattcgacgagacattcagtggcaaggttttcctgaccgtcttcgatggcagaaagaaaatgacagctttggaagaggagggaaacgatctctctcttgtatattatgactatcctaacgtgatgtatgccggtattgccgaggtgaaagacggactcttcgaaacttcgtttatcgtacccaaggatgtgaactattccgagcacgaaggccggatcaatctttatgcttataacgagagcacaaaggcggaagccatgggggtagacttctccatcagagtccaaccgggtattcctgatgaggtaacggaagataatacaccgcctgaaatcataagctgcttcctcaatgacagtacattccgatcgggagatgaggttaatcctactcctctgtttatggccgaagtattcgacttgaatggaatcaatatcacgggtagcggagtagggcatgatattacgctttgtatcgatggccgtgccgacctgacctacaacctcaatgcatatttcacaagttcggctacggatgcaggtgtgggcactattctcttcatgataccggctttggccgaaggagatcatactgcccgactgacggtttgggacattttcaataatgccgtccatcatgacttttcattcagagtggtagatggcattgctccggatgtggctgatgtgattctattcccgaatccggtacgcgagagtgctacgttccgaatcttccacaatcgccccggaagcgatttgaacgtggccgtggagatctatgacttcaccggtcgtcttgtgaacagtttgccagtcaagacctattcgtcttcctacggagaacctatagagatcaagtgggatctgacctccaaatacggagtgaagatcggaaacggattctacctctatcgttgtgtggtgaactctcccggaggacagacggcctccatggccaagaaaatgatcgtggtaggacaa

SEQ ID NO: 117 - DNA, 2919 bp, Porphyromonas gingivalis
ttttacaccggaattgacttgcatatagaaagccaaatgaagaaacttttcccattattattactcatattgtcgattttggtcggatgtggaaaaaaagaaaaacactctgtaactgaaatcgcccgagagaaaaagcgtattactgcattgctgtacgaaaaagaactccccactgattctgttaaacagctttacgagaacagcgtacagaacaagaaccttgtgggacaaatgttattcgcgatcgaggtcggcaaacggatgcgtaatatgtcccaatacacagatgcgatgctatatcaccaaaaagggttgaacgctgcattgaatctaagggacaccatcgtagccgcacaagcatggaatcatctcggaacggatagccgtcgtatcggtgctttggcagaagcttcggattatcattacaaggctctttccttgatagaatcttttagcggaaaccagaataggcctgcgatcaaagccagatcggcggccctgaacggcatcggcaacatcaatcttgagttaggataccatgatgaggccgaaaagaatttcctgaaagcactgcaaggtgagaaagaactcgacagtcctctcgggcaagctatcaactatgcgaacctcggacgtatctatcgacaacgcaaagaatacgacaaggctcgtacctacttcctcttgtctctggagcagaacaatatggcagagaatctgatgggtatcggactctgtagcatcaatctcggagaagtagacgaagaaaaaggggattatcaaaaggctttgcaagagtatgccacggcatacaaactgatggaacagttgtccgatcgatggcactggctgaattcctgtatcccgatggcacgtatcaatctcaaacaaggtaacgaaaggctctaccagcatttcatttctttggccgaagggactgcgaaagaaattaattcgacttcacatctgatagaaatatacaatcttcaatacgagaatctcgagcgtaaaaaagaatacaaacaagccctcgaagcattctgtctgagcaagacgttgagcgacagcatgtccattgcgcacaaggtcagcagcatacaagaaacgcgattcaactacgaacgaaacaagtcccaaaaagagcttgaagaaatacagcaagtaagcaaggcaaaacaagagaaatcgaagtttatcctcttgagcactctttttgcccttttcatctcgattcttttgatttctgttctgacatatgcataccgtcagggcaagaagcataacaagctgatcaaagagacggataaacttcgctccggctttttcaccggtattacacacgaatttcgtacgcctatcaccgtcatacaaggtttgaatgagaaaatgagttcaagtcctgatctccaagcatcggacagaaccgagctgcacaagataatagacagacagagtagccatatgctgaatttggtgaaccagctgttggatatttgcaagatcagaagcggagtatccacgcccgaatggcgcaatggcgacatcgtctccttcgtacagattctcatcgattcgtttgcaccatacgcacaggctcaagacataaccttggagctacaacccgagagcaaacctattgtcgtggacttcgtcccctcctacttgcaaaaaatcatatccaatcttttgtccaatgccatcaagtattctttagccggagggagagtggtcatatctctggcaaaaaccaagaatgaaaaaaatctgatcatacgcgttgcagacaatggcataggaatagataaaactgatcaggctcatatcttcgacatcttctatcgaggacagtccgctaccgaaaagcatggatcaggcgtcggactctcgtttaccaatatactggtcgaaaaccttcgaggtacgatcaaagtggaaagccagccggggaaaggaagtgccttcaccatcagtattcctacacaaaaccagtcctcttcggcagagattcttccttggctaccctcctccgatgacattgtcatgcctgtccacatcgcgcccgatgactcaccgacatctccgatggtagcagctctgaatcatcgcttcgaggacgaacgtccgaccatactgctcgtcgaggacaataaggatatcaacctgctcgtcaaactactcctttgcgatcgctacaatgtgctatccgccgcaaacggaaaagagggtatagccctcgctaccgagcatattcccgacattatcattacggatattatgatgccgataatggatgggatagaaatgacaatccggatgaagcaatcgcctctgctctgtcacattcccattgtcgctttgacggccaagagtaccgaacaggacagattggaaggaatcaaaagcggtgtagtctcttatctatgcaagccattctctccggaggagcttttgatgcggatcgagcagcttctgaaagaccgtgagttgctcaagaagttctatatgcaaaaactcatgctggatcggaagccggaggaggagcctcaaccgatagatgacagcagtatgcagtttctccttgctgccaaagatgcagtgtccggtggaatcaaacaaaatccggatttttccgctcaagacttggccgaaaaaatgtgcatgagtccatcccaactcaacagaaagctcacgagtgtcgtaggttgctccaccatcggctacatacagcagatcaagataaaattggcctgcaagctccttgccgatgagagcaaaaacatctccgacattagcattgaggcaggcttttcggatccggcttacttctctcgcaccttcaaacgctacatgaactgctctccctcccaatatcggcaaaaactccttgccatgccggggagcgacaaggagacagtt

SEQ ID NO: 118 - DNA, 1689 bp, Porphyromonas gingivalis
catcataaaacatatcaaacaatgaaaaagcttttacaggctaaagccttgattctggcattgggactcttccaactgcccgcaatcgcccaaacgcaaatgcaagcagaccgaacaaacggtcaatttgcaacagaagagatgcaacgagcattccaggaaacgaatccccctgcaggtcctgtgcgtgctatcgctgagtacgaacgctctgcagccgttttggtacgctacccgttcggtatcccgatggaattgatcaaagagctggccaagaacgacaaggtgattaccattgtggcgagtgaaagccaaaaaaacaccgttataacccagtacacccaaagcggtgtgaatctctctaattgcgatttcatcattgcgaaaactgactcttactggacacgcgactataccggttggttcgcaatgtacgatacgaacaaagtaggtctcgtggactttatttataaccgccctcgtcctaacgatgatgaattccccaaatacgaagcacaatatctgggcatcgagatgttcgggatgaagctcaagcagaccggtggcaactacatgacggacggatatggatccgctgtgcagtcacatatcgcatatacggagaactcctctctgtctcaagctcaagtaaatcaaaagatgaaagactatctcggcatcacacatcatgatgtggtacaagatccgaacggcgaatatatcaaccatgtggactgttggggcaagtatttggcaccgaacaaaatcctcatcaggaaagtgcctgacaatcaccctcagcaccaagccctggaagatatggcagcctacttcgcagcacagacctgcgcatggggaacgaagtacgaggtatatcgcgctttggccaccaatgaacaaccgtacacgaactctctgattctgaacaacagggtatttgttcctgtcaatggccccgcctccgtggacaacgatgctctgaacgtctataagacggcaatgcccggttacgaaattataggtgtcaaaggggcttcaggaacaccttggttaggaacagatgccctgcattgtcgtactcacgaggtagcggataagggctatctctatatcaagcactacccgatactgggcgaacaggcaggccctgattataagatcgaagcagatgtcgtctcatgcgccaatgctactatctcgccggtacaatgttactatcgtatcaatggttccggtagctttaaggctgctgatatgacgatggaatcaacaggtcactatacttatagctttacaggtcttaacaagaatgataaggtagaatactatatctctgccgctgacaatagtggtcgcaaagagacttatccctttatcggcgaacctgatcctttcaagtttacgtgtatgaacgaaaccaatacatgtactgtgaccggagctgccaaagctcttcgtgcatggttcaacgccggtcgttcagaactggctgtttcggtaagtttgaatattgccggcacatatcggataaagctttataacaccgcaggagaagaagtcgctgcaatgaccaaggaattagtagcagggacgagtgtcttcagtatggatgtgtattctcaggctccgggcacatatgttctggttgttgaaggaaatggaatccgtgagacaatgaaaattctcaaa

SEQ ID NO: 119 - DNA, 1311 bp, Porphyromonas gingivalis
accacaaatagaaaaccaaatactaatatgaaactttcatctaagaaaatcttagcaatcattgcattgctgacgatgggacatgctgtgcaggcacagtttgttccggctcccaccacagggattcgcatgtctgtcactacaaccaaggccgtaggcgaaaaaatcgaattgttggttcattccatagagaagaaaggcatctggatcgatctcaatggggatgccacttaccaacaaggagaggaaataaccgtattcgatgaggcataccacgaatacacgatcgggacgcaaaccctcactatctatggtaatacgacccgattgggctgtcgatctaccggtgcaacggctgtcgatgtaacgaaaaaccctaatctgacctatctcgcatgcccgaaaaataatctgaaatcattggacttgacgcaaaacccaaagctgctgcgagtttggtgcgactctaacgaaatagaaagtttggacctgagtggcaatccggctttgatcatcctcggctgtgacaggaataagctgactgagctgaagaccgataacaaccccaagttggcctctctttggtgttctgataataacctgacggagttggaactcagtgccaatcctcgtctcaatgatctttggtgcttcggtaatcggatcacgaaactcgatctgagtgccaatcctctattggtaacactttggtgcagtgacaatgagctttcgaccttggatctttccaagaattcggacgttgcttacctttggtgttcatcgaacaaacttacatccttgaatctgtcgggggtgaagggactgagtgttttggtttgtcattccaatcagatcgcaggtgaagaaatgacgaaagtggtgaatgctttgcccacactatctcccggcgcaggcgctcagagcaagttcgtcgttgtagacctcaaggacactgatgagaagaatatctgtaccgtaaaggatgtggaaaaagctaaaagtaagaactggcgagtatttgacttcaacggtgattctgacaatatgcttccatacgaaggaagtccgacatcgaacttggcagtagatgctcccactgtcaggatatatcccaatccggtaggaagatatgcgctcgtcgagatccccgagtctcttttagggcaggaagctgctttatacgatatgaatggggtaaaagtctatagtttcgcggtagagtctcttcgtcagaacattgacctgacacatcttcccgacggcacttatttcttccgtctcgataactataccactaagctcatcaaacag

SEQ ID NO: 120 - DNA, 954 bp, Porphyromonas gingivalis
aatcatttgaagacaaatatcaagatgagaaaaacaataattttctgcttgttgctcgccctatttggctgttcttgggcacaagaaagagtcgatgaaaaagtattctccgcaggaacaagtatttttaggggcatccttgaaaaggtgaaagcaccgcttatgtatggagatcgtgaggtatggggtatggctcgtgcgagcgaggatttcttttttatacttcccgttacggatgacctcactcccgtgcttttctataaccgtcttacaaacgaaccctgctttgtgtcagaccaaggaataactgagtatttcaaattcgctcaagaaggtgattacattgaagtcgaaggaagctctgtattcatggcgaatcttttgtactatcgttttttcccgacaagaattacctcctataatgctcccattgaaggtgttgtgagcaagacgggaaatcctgcttttacaatcccgatgctcccgggggtttctgattgcatagaaatctcaaacaaccgcaaagtctttctgaccaatcaattaggggttgtaaacatcactgacgggatggaacctccgattattgccggagtctctgcttcctatggatcttccgtccgggtgtatggtcatgtctcacagcggtgggacatcataggccattgctatttggatatctacccaaccaattgctatccgctcagcacgaaacccgttgcaggagacgatgaggtttttgtcaaacaacaaggcaggcaaatagagatcgatagcaacagccccatagtccaagtggtcgtatacgatcttgaggggaaaagtgtttttcgcaaaagaatgaccgaaaacgcttataccctatcctttagagcacccatgctcggctttatgaccatcatgatcgaaacacaaaattcgattatcaataaaaaacttaatgttacacagcta

SEQ ID NO: 121 - DNA, 1383 bp, Porphyromonas gingivalis
agacgggcagttaaaatccgatcacctccccatatccactcattatttgtacgtaaatgtcttttttcagactttaaatacttatatttatcccgaaaaattacccaagagagattgggtcgattgtcgatccgtcttaagtcatacaatccaataatcattattgaaatgaaaaaaacaaccattatttctttgattgtcttcggtgctttctttgcagccgtgggccaaaccaaggacaattcttcttacaaacctttttcgaaagaagatattgccggaggagtttactctctcccgactcaaaatcgtgcgcagaaggacaatgccgagtggcttcttacagcgaccgtctccacaaaccagtctgcagatactcactttatcttcgatgagaacaaccgctatatcgctcgtgacataaaagccaatggggtaagaaaatccacggactccatttactacgatgccaacgggcgaatatcgcatgtggatctttatatctcgttcagtggcggagagcctgcactcgacacccgattcaagtacacctatgatgacgagggaaagatgaccgtgagggaagtattcatgctggtaatggatccgaatacacctatctcacgcttggaatatcattatgatgcacagggcagactgacccactggatttcttttgctttcggggcagaatcccaaaagaatacgtatcactataatgaaaaaggtctgttggtcagcgaagtgctgagcaatgcaatggggacaacctattcagacaccggcaaaacggaatacagctatgacgatgcagataatatggtgaaggccgagtacttcgtcgtccagcaaggaaaggcatggcaagtactcaaaagagaggaatacacctatgaggacaatatctgcatacaatatttggctattaacggtaccgacacaaaggtgtacaagcgagacatcgagagcgataagtccatctccgcaaatgtcattgacattccgtcaatgccggaacagacctggcctaatatgtacggattcaacgcaaagcgactgaaagagacttattcctcctacgaaggagatgtggctactcctatattcgactatatctatacgtacaaggctcttacctcaatggcaacaccttcgacagaagctcaggtagcagtctatctcaatccgtcaacggaccggttagtgattctggccaacggcatcacacatctgagcatgtacgacttgcagggtaagcttatccgtgattgtgccttgagcggcgataaggtggaaatgggtgtcggatctttgaccaaagggacatacctgcttaaagtgaatacggatcagggagcctttgtgagaaaagtcgtgattcga

SEQ ID NO: 122 - DNA, 1353 bp, Porphyromonas gingivalis
atggcaaaagttataaaaacaaaaaaaggccttgcacttaatctgaaaggaaaaccgctgcccgagatgctggccgaaccggcccaaagtcctacttacgcggtcgtgcccgacgattttgaaggtgttatccccaaggtgacggctcgtccgggggataaggtgcgtgccggctcagcactgatgcaccacaaggcatatccggagatgaagtttacaagtccggttagcggcgaagtgatcgcggtgaatcgcggtgccaagcgcaaggtgttgagcatcgaggtgaaaccggacggactgaacgaatacgagtcattccctgtcggggatccgtctgccctctctgccgaacagatcaaggagcttttactgtcgagcggtatgtggggttttattaagcaacgtccttacgacatagtggctacaccggatatagctccacgcgacatttatattactgccaactttactgcaccattggctccggacttcgatttcatcgttcgaggagaagaacgcgccctgcagactgccatcgatgccttggccaaactcacgacaggaaaggtgtatgtgggcctgaagccgggttcatctctgggcttgcacaatgcagaaatcgtagaagtacacggacctcatccggcaggtaacgtgggcgtgctgatcaatcatacgaagccaatcaatcggggcgaaacggtgtggacgctcaaggctaccgacctgatcgtgatcggacgtttcctgcttacgggcaaagccgattttaccagaatgattgccatgaccggctcagacgctgcagctcacggatacgtccgtattatgccgggttgcaatgtctttgcttccttccccggccgactgacaataaaggaatctcacgagcgtgtgatcgatggcaatgtgctgaccggtaagaagctctgcgagaaggagcctttcctgtcagcccggtgtgaccagatcacggtgatccccgaaggcgacgatgtggacgaactcttcgggtgggctgcaccccgtctcgatcagtacagcatgagcagagcttatttctcttggttgcaggggaaaaacaaagagtacgtactcgatgcccggatcaagggtggcgaacgtgctatgatcatgagcaacgagtatgaccgcgttttcccgatggacatctatccggagtatttgctcaaggctattatagcattcgacatcgacaagatggaggacttaggcatatatgaagtggctccggaggactttgccacttgcgaatttgtggatacatccaagatcgagctgcagcgtatcgttcgcgagggcttggatatgctctataaggaaatgaat

SEQ ID NO: 123 - DNA, 585 bp, Porphyromonas gingivalis
atggataaagtgagctatgctctgggattgagcatcggtaataatttcaagtcttcgggcatcgacagcgtcgttatggatgatttcatgcaaggtctgtctgatgtactggaagaaaaagcccctcagctctcgtatgacgaggccaagcgcgaaatagaggcgtatttcatggatttgcagcagaaggctgtcaaactgaacaaagaggccggagaagaattcctcaagataaatgcacacaaggaaggtgtgacgaccttaccgagcggcttgcaatacgaagtcattaagatgggagagggcccgaaacccaccctttcggacacggtaacctgtcattatcacggtacgctcatcaacggtatcgttttcgatagctctatggacaggggagaaccggccagtttccctctaagaggagttatagccggctggacggagattcttcaattaatgcctgtaggatccaagtggaaagtaactataccgagcgatctggcgtatggagatcgtggtgccggcgaacatatcaaaccgggtagtacgctcatttttataatcgaattattgagtatcaacaaa

SEQ ID NO: 124 - DNA, 819 bp, Porphyromonas gingivalis
atgaaaaaagcattacttattggtgctgctcttttgggagcagtcagttttgcaagtgctcagtctttgagcacaatcaaagtacagaacaattcagtacagcaacctcgtgaggaagccactattcaggtttgtggagaattggcagagcaagttgactgcattgggacaggtaattctgcaatcatagccgctgcagcgaaatttgaaagcgatgatctcgaaagctatgttggctgggagatcatgagtgttgatttcttccctggatataaagcgtgcaagtacacatctgcagtctgggctgatgatatgaccattttgggccaatcagaagatagtgatcccgaaatgcagactatcaacaatcttgctctcaagactagtgtcaagattgaagccggcaagaattacatagttggttatattgctaataccgcaggtggacatcctatcggatgtgatcagggccctgccgttgatggttatggagatttggtttctatatcagaagatggtggtgctactttccctccgttcgaatctcttcatcaagcagttcctaccttaaattacaacatctatgtcgttgttcatttgaagaagggtgaaggtgttgaggctgttcttaccaacgacaaggctaatgcttatgttcagaatggcgttatctatgtagccggagctaatggtcgtcaggtatctctgttcgacatgaacggtaaggttgtttataccggcgttagcgaaacgattgcagctcctcagaagggcatgtatatcctccgtgtaggtgctaagagcatcaagctggctatc

SEQ ID NO: 125 - DNA, 1662 bp, Porphyromonas gingivalis
atgccaagaattatgaaattaaaaattgcactcagactgctgctggcgacttttgccatagttttatttagccctctggccaaggcccagatggatattggtggagacgatgtattgatcgagacgatgtccaccctatcaggatattcagaggatttttattacaagatggctgtggcagacaatggatggatctatgtgatgttggatttctctcgtatttattttgatgatgtcaggctgtatcgttccaaagacggtggtgctacttaccaaaagttagggtctttggggtctttggtgccttatgacttcgatgtctcgcattgcgattttattgtaacgggaaaggatgaagatgatatcaatgtttggacagtcatgacagcattcgaatatgtaggtggtactattggcaatggcgttttgctgatgcatcgccatgatgcagatatcaataatacagagtgtgtgtacaagaaggatttccctaataatagactgatgggtgtagccatcgcctccaactaccgtgcgccctctccttacggtttggggggcgatccttttgctctcgctgtcgccgttagtggctccggaagcgatcacagcttcttggactatattttttcgttagatggtggagtacactttgagcaaaagcgtatttacacaagaccccaaaaactgactatcaatagagtagacctttcattaggcagtacatctccttctcttggatttaatacttggccactaatgggagtcgtattcgaaatgaataagaaccttgatggcttcgacattggtttcatttccaactttgtggactatgatccccgctatgcgtggtctgaaccgataataatagaagaagactgtggatggactgattttaatcctttgggagcactaagtatagagatccaaatgatgttggatgacaattcggataataccgtgggtggagaacgctcccataacttcctgatcacttacccgggccattacgtatatccgaagcaatctttcaattattctcccggacatacaccgacaaagaaagatctggtctttaaacactgtataggtattccggctttggcatacgataaggaaggcgatcgttatctgactacttttcaagatcacaatctaatgagatacagatggatcaaatacgatgacattaactctttttatggttggagttggccatatgtatatgcaaaagaagctaaagataaaaagaggcgccgtccgcaagtagcactcaatcctaccaatggaaaggcttgttgggtatggcatactcgcaagagcccatatgatgaaaccaaaccacatcctactcctgtaattattaaacatttcctatggtccgatacggagtgggtacatgctctggacgtgggggacgtattgcagaaggagggtagcatgaagctctaccccaatcctgccaaagaatatgttctgatcaacctacccaaagaaggggggcacgaggcagtcgtatacgacatgcagggccgaatcgtggagaaagtttcattttcagggaaagaatataagctgaatgtgcagtatctgtccaaaggtacgtacatgctgaaagttgtagcggatacggagtatttcgtggaaaaaatcattgtagag

SEQ ID NO: 126 - DNA, 1650 bp, Porphyromonas gingivalis
atgaaattaaaaattgcactcagactgctgctggcgacttttgccatagttttatttagccctctggccaaggcccagatggatattggtggagacgatgtattgatcgagacgatgtccaccctatcaggatattcagaggatttttattacaagatggctgtggcagacaatggatggatctatgtgatgttggatttctctcgtatttattttgatgatgtcaggctgtatcgttccaaagacggtggtgctacttaccaaaagttagggtctttggggtctttggtgccttatgacttcgatgtctcgcattgcgattttattgtaacgggaaaggatgaagatgatatcaatgtttggacagtcatgacagcattcgaatatgtaggtggtactattggcaatggcgttttgctgatgcatcgccatgatgcagatatcaataatacagagtgtgtgtacaagaaggatttccctaataatagactgatgggtgtagccatcgcctccaactaccgtgcgccctctccttacggtttggggggcgatccttttgctctcgctgtcgccgttagtggctccggaagcgatcacagcttcttggactatattttttcgttagatggtggagtacactttgagcaaaagcgtatttacacaagaccccaaaaactgactatcaatagagtagacctttcattaggcagtacatctccttctcttggatttaatacttggccactaatgggagtcgtattcgaaatgaataagaaccttgatggcttcgacattggtttcatttccaactttgtggactatgatccccgctatgcgtggtctgaaccgataataatagaagaagactgtggatggactgattttaatcctttgggagcactaagtatagagatccaaatgatgttggatgacaattcggataataccgtgggtggagaacgctcccataacttcctgatcacttacccgggccattacgtatatccgaagcaatctttcaattattctcccggacatacaccgacaaagaaagatctggtctttaaacactgtataggtattccggctttggcatacgataaggaaggcgatcgttatctgactacttttcaagatcacaatctaatgagatacagatggatcaaatacgatgacattaactctttttatggttggagttggccatatgtatatgcaaaagaagctaaagataaaaagaggcgccgtccgcaagtagcactcaatcctaccaatggaaaggcttgttgggtatggcatactcgcaagagcccatatgatgaaaccaaaccacatcctactcctgtaattattaaacatttcctatggtccgatacggagtgggtacatgctctggacgtgggggacgtattgcagaaggagggtagcatgaagctctaccccaatcctgccaaagaatatgttctgatcaacctacccaaagaaggggggcacgaggcagtcgtatacgacatgcagggccgaatcgtggagaaagtttcattttcagggaaagaatataagctgaatgtgcagtatctgtccaaaggtacgtacatgctgaaagttgtagcggatacggagtatttcgtggaaaaaatcattgtagag

SEQ ID NO: 127 - DNA, 1170 bp, Porphyromonas gingivalis
atgaaacgattactcccctttctccttttagcaggactcgtagccgtaggaaacgtgtctgctcagtcaccccgaatccctcaagtggatgtacacactcgcatcgcaagaaatgcccgttatcgactggacaagatcagtgtcccggattctcgtcagatattcgattacttctataaagaagaaacgatacccactaaaatacaaacgaccacaggaggtgcaattacaagcatcgattcgcttttctatgaagacgacaggttggttcaggtgcgctattttgacaataaccttgaattaaaacaagcggagaagtatgtatacgacggttctaagctggtccttcgagaaattcgcaagtcgccgacagacgaaacgccaataaagaaagttagctatcactatctctgtggcagcgatatgccttttgagattacgacagagatgagcgatggctattttgaaagccatacgcttaactatctgaatggaaagattgcccgaatagatatcatgactcaacagaacccatcggccgaattgatcgaaacgggtagaatggtatatgagtttgatgccaataatgatgctgtactgcttcgtgacagtgtatttcttcctcttcaaaacaagtgggtagaaatgtttactcaccgttatacatacgacaataagcataattgtattcgttgggaacaagacgaattcggcaccctcacccttgccaacaacttcgaatacgacaccactatccctctgtcgtctgtattgttccccacgcatgaggagttcttccgtcctcttcttcccaattttatgaagcatatgcgtacgaagcaaacgtatttcaataactccggagaaggcttgtcagaggtatgcgattacaactacttctataccgatatgcagggtaatgcactgaccgatgttgccgtgaacgaatcgatcaagatttatcctcgtcctgccacggattttctgcgtatagaaggttcgcaactgcttcgcctttcgctattcgacatgaacgggaagctcatcagagctaccgaattgacaggcgatttggccattatcggagttgcatctcttccgagaggcacttacatcgcagaaataactgctgcaaacagcaaaaccatacgtgcaaaagtatcgctcaga

SEQ ID NO: 128 - DNA, 1233 bp, Porphyromonas gingivalis
atgagacagcatttatctctatttccttttatcttgtttctgcttcttgccttctcttatgtcggttgcagaacagtccgacaaacacctaagcagtcggaacggtacgtcgtagtcctgtctttggacggcttccgaccggactataccgatcgggcacgtacaccggcgttggatcggatggcacaggagggattgagcgggtcgctccaaccatgcttcccctcgcttacatttcccaatcattacagcatggctacggggctttaccccgatcatcacggtatcgtagccaatgagtttgtggattcgctactgggcatctttcgtatatccgaccgaaaagccgtggagacccccggattttggggcggcgagccggtttggaatacggccgcacgccaaggcatccgtaccggtgtctacttttgggtaggatccgaaacggctgtgaacggaaatcggccgtggcggtggaaaaaattctcctccaccgttccgtttcgtgaccgtgccgactccgtcatcgcgtggctcggactgcccgaaaaggagcgaccgcgcttgctcatgtggtacatcgaggagccggatatgatcggacacagccaaacgcccgaaagcccgctgacactggcaatggtagagcggttggacagtgtggtcggctatttccgcaagcggttggactctctgcccatagccgcacagaccgacttcatcatagtatccgatcacggtatggccacgtacgaaaatgagaaatgtgtcaatctgtcgcattatctgcctgcggacagtttcctctacatggccaccggggccttcacccacttgtacccgaagccctcctataccgagcgagcctatgagatcctgcgggccattccacatatatcggtttaccgcaagggggaggtgcccaagcgtttgcgctgtggcaccaatcctcgtttgggcgaactggtcgtgattccggacataggctccaccgtctttttcgcaataaatgaagacgttcgtccgggagcggcacatggctatgacaaccaagcaccggaaatgcgggctttactccgggctgtcggacccgatttccgtccgggcagtagggtggaaaacctgccgaatatcaccatctatccgctcatatgcaggctgttgggtatagagcctgcacccaacgatgcggacgaaacgttgctgaacggcctgatccgagacaaacgacca

SEQ ID NO: 129 - DNA, 738 bp, Porphyromonas gingivalis
atgaaagtaggtttgttcatcccctgttatgtcaatgcagtgtatccggaagtgggtatcgccacgtacaaactgctgaagagtttggacatagatgtcgactacccgatggatcagacatgttgcggccagcctatggccaatgccggattcgaacagaaagctcaaaagctggctttgcgattcgaagagctgttcgagtcgtatgatgtagtcgtagggccatcggccagttgcgttgctttcgtgaaagaaaactatgatcatatcctcagaccgacaggacatgtctgcaagtcggcagccaaggttcgggatatatgcgagttcttgcacgatgacctgaagatcaccagcctcccctcccgattcgcccataaggtgagcctgcacaacagttgccacggtgtgcgcgaactgcatctgtccacccccagtgaagtgcaccgaccgtaccacaacaaggtgcgccggctattggagatggtgcagggcatagaggtattcgagccgaagcgaatagacgaatgctgcggtttcggcggtatgtactcggtggaggagccggaggtatccacctgtatggggcatgacaaggtgctggatcacatatccacaggtgcggagtacatcacagggccggacagctcgtgcctcatgcatatgcagggagtgatagacagagagaaattgccgatcaagacaattcatgcagtagaaattttagcagcaaactta

SEQ ID NO: 130 - DNA, 738 bp, Porphyromonas gingivalis
atggatattgtaagtatggccgataaagctcttgtagtggagatgagagatgtgacgctctgtcaggaggaaaacgtcatttttcaaaatttgaatctgaccctttccgccggagacttcgtctatctgataggctcagtgggatcggggaagagcactttgctgaaggctttgtatgctgaggtgcctatctctgccggttatgcccgcgtgatagattatgatctggcaaagttgaaacggaagcagttgccctatctgcgcaggaatttgggcattgtgtttcaggatttccagttgctgaacggacgtactgttgcggagaatttggatttcgttttgcgagctacggactggaaaaaccgagccgatcgcgagcagcgtatcgaggaggttttgacccgtgtgggaatgtctcggaaggcttataagagaccgcacgaactgtccggaggggagcaacaacgtgtgggtatagccagagctttgctggcgaagcctgcgttgatcctggccgacgaacccacaggcaacctcgattcggtgaccggattgcagatcgcttctctgctctacgaaatcagtaagcagggcactgcagtacttatgagcacgcacaacagcagcctgctgtcgcatctgccggcacggacattggccgttcgtaagaatggcgatgcctcctctttggtcgagctgagtgcagatgctgtttcaagaaaaaatacggaaatagat

SEQ ID NO: 131 - DNA, 723 bp, Porphyromonas gingivalis
atggccgataaagctcttgtagtggagatgagagatgtgacgctctgtcaggaggaaaacgtcatttttcaaaatttgaatctgaccctttccgccggagacttcgtctatctgataggctcagtgggatcggggaagagcactttgctgaaggctttgtatgctgaggtgcctatctctgccggttatgcccgcgtgatagattatgatctggcaaagttgaaacggaagcagttgccctatctgcgcaggaatttgggcattgtgtttcaggatttccagttgctgaacggacgtactgttgcggagaatttggatttcgttttgcgagctacggactggaaaaaccgagccgatcgcgagcagcgtatcgaggaggttttgacccgtgtgggaatgtctcggaaggcttataagagaccgcacgaactgtccggaggggagcaacaacgtgtgggtatagccagagctttgctggcgaagcctgcgttgatcctggccgacgaacccacaggcaacctcgattcggtgaccggattgcagatcgcttctctgctctacgaaatcagtaagcagggcactgcagtacttatgagcacgcacaacagcagcctgctgtcgcatctgccggcacggacattggccgttcgtaagaatggcgatgcctcctctttggtcgagctgagtgcagatgctgtttcaagaaaaaatacggaaatagat

SEQ ID NO: 132 - DNA, 696 bp, Porphyromonas gingivalis
atgagagatgtgacgctctgtcaggaggaaaacgtcatttttcaaaatttgaatctgaccctttccgccggagacttcgtctatctgataggctcagtgggatcggggaagagcactttgctgaaggctttgtatgctgaggtgcctatctctgccggttatgcccgcgtgatagattatgatctggcaaagttgaaacggaagcagttgccctatctgcgcaggaatttgggcattgtgtttcaggatttccagttgctgaacggacgtactgttgcggagaatttggatttcgttttgcgagctacggactggaaaaaccgagccgatcgcgagcagcgtatcgaggaggttttgacccgtgtgggaatgtctcggaaggcttataagagaccgcacgaactgtccggaggggagcaacaacgtgtgggtatagccagagctttgctggcgaagcctgcgttgatcctggccgacgaacccacaggcaacctcgattcggtgaccggattgcagatcgcttctctgctctacgaaatcagtaagcagggcactgcagtacttatgagcacgcacaacagcagcctgctgtcgcatctgccggcacggacattggccgttcgtaagaatggcgatgcctcctctttggtcgagctgagtgcagatgctgtttcaagaaaaaatacggaaatagat

SEQ ID NO: 133 - DNA, 657 bp, Porphyromonas gingivalis
atgattgaaatcagcaacctcaccaaggttttcagaacagaagaaatagagacggtagccctcgatggcgtatcgctcaaagtggacaaaggcgaatttatcgccataatggggccttcgggatgcggtaagtccactctgctcaatatcctcggccttctcgacaatcccacttccggtatctacaagctcgatggggcagaagtgggcaacctccgggaaaaagacaggactgccgtccgtaagggcaatatcggcttcgtattccagagcttcaacctcatcgaagagatgacggtaagcgagaacgtggagttgccgctcgtctatctgggtgtgaaggcctccgagcggaaagagcgagtggaggaggcactgcgcaagatgagcatcagccaccgggccggccacttccccaatcagctctccggaggacaacagcagcgcgtggctatcgcccgtgccgtggtggccaatccgaagctcatcctcgccgatgaacccacgggtaacctcgactccaaaaacggagccgatgtcatggaactgctcagaggtctcaatcgcgaaggtgcaaccatcgtcatggtgacgcactccgagcacgatgcacgtagtgccggccgcatcatcaatctgttcgacggtaagattcgc

SEQ ID NO: 134 - DNA, 1785 bp, Porphyromonas gingivalis
  modified_base (172)..(172): n is a, c, g, or t
atgaaagaatttttcaaaatgtttttcgcctcgatcctcggggttataacggcaggaatcatcttgttctgtatctttctatttatctttttcggcatcgtagccggtattgcctccaaggcaacgggaggaaccattccgaagatcgaagcaaactccatcctacatatanacaattcttctttccctgagatcgtatcggccaatccctggagcatgctcacaggcaaagacgagtccgtatcgctctcacaggcagtcgaagccatcggccaagccaaaaataatcccaacataaccggtatcttcctcgatctggacaacctttccgtcggtatggcatcggcagaggaattgcgtcgcgcgttgcaggatttcaagatgtcgggcaagttcgtcgtatcctatgccgacagatacacccaaaagggttactacctctccagtattgcagacaaactctacctcaatccgaaaggaatgttggggcttatcgggattgcgacccaaacaatgttctacaaagatgccctcgacaaattcggcgtgaagatggagatcttcaaggtaggcacctacaaggcagccgtagagccattcatgctcaacaggatgagcgatgccaatcgcgaacaaatcaccacatacataaacgggctttgggacaagatcacatccgatattgcagagtcgcgcaagacggcaatggattccgtgaaaatgtttgccgacaaaggcgaaatgttcggtcttgccgagaaagcggtggagatgaagctcgtggatgagctggcttaccgtaccgatgtggagaaagaactcaaaaagatgtcccaacgcggagagaaagatgaacttcggttcgtatcgctttctcaggttctggccaatggcccgatgaacaaaacgaaaggcagtcggatcgccgttctctttgccgaaggtgaaataacggaagaaataataaagaagccgttcgacactgacggtagctccatcacacaagaactcgccaaagaaatcaaggcagcagccgatgacgatgatatcaaagccgtagtacttcgtgtcaattctccgggaggtagtgctttcacttccgaacagatatggaagcaggtagccgatctcaaggccaaaaagcctatcgtggtctccatgggcgacgtagcagcctcgggcggatactacatagcctgcgcagccaacagtatcgtggcagagcatacgactctgaccggctccatcggcatattcggcatgttcccgaacttcgcgggcgtagccaagaagataggagtgaatatggacgtcgtacagacatccaagtatgcagacttgggcaacaccttcgctccgatgacggtcgaagatcgtgccctcatccaacgctacatagagcagggctacgacctcttcctcactcgcgtatcggaaggccgcaaccgcaccaaggcacagatcgacagcatcgctcaaggccgtgtatggctcggcgacaaagctcttgcactcggtttggtggatgagcttggaggtttggacacagctatcaaacgggccgcgaagctggctcagctcggtggcaactacagcatagagtatggcaagaccaagcgcaacttcttcgaagagttgctctcctcatcagcagcggatatgaagtctgccatcctgagtaccattctctccgatccggaaatagaagttctgcgcgaactccgctccatgccgccccgtccttcgggcatacaggcacgtctcccctattacttcatgccgtac

SEQ ID NO: 135 - DNA, 1767 bp, Porphyromonas gingivalis
  modified_base (154)..(154): n is a, c, g, or t
atgtttttcgcctcgatcctcggggttataacggcaggaatcatcttgttctgtatctttctatttatctttttcggcatcgtagccggtattgcctccaaggcaacgggaggaaccattccgaagatcgaagcaaactccatcctacatatanacaattcttctttccctgagatcgtatcggccaatccctggagcatgctcacaggcaaagacgagtccgtatcgctctcacaggcagtcgaagccatcggccaagccaaaaataatcccaacataaccggtatcttcctcgatctggacaacctttccgtcggtatggcatcggcagaggaattgcgtcgcgcgttgcaggatttcaagatgtcgggcaagttcgtcgtatcctatgccgacagatacacccaaaagggttactacctctccagtattgcagacaaactctacctcaatccgaaaggaatgttggggcttatcgggattgcgacccaaacaatgttctacaaagatgccctcgacaaattcggcgtgaagatggagatcttcaaggtaggcacctacaaggcagccgtagagccattcatgctcaacaggatgagcgatgccaatcgcgaacaaatcaccacatacataaacgggctttgggacaagatcacatccgatattgcagagtcgcgcaagacggcaatggattccgtgaaaatgtttgccgacaaaggcgaaatgttcggtcttgccgagaaagcggtggagatgaagctcgtggatgagctggcttaccgtaccgatgtggagaaagaactcaaaaagatgtcccaacgcggagagaaagatgaacttcggttcgtatcgctttctcaggttctggccaatggcccgatgaacaaaacgaaaggcagtcggatcgccgttctctttgccgaaggtgaaataacggaagaaataataaagaagccgttcgacactgacggtagctccatcacacaagaactcgccaaagaaatcaaggcagcagccgatgacgatgatatcaaagccgtagtacttcgtgtcaattctccgggaggtagtgctttcacttccgaacagatatggaagcaggtagccgatctcaaggccaaaaagcctatcgtggtctccatgggcgacgtagcagcctcgggcggatactacatagcctgcgcagccaacagtatcgtggcagagcatacgactctgaccggctccatcggcatattcggcatgttcccgaacttcgcgggcgtagccaagaagataggagtgaatatggacgtcgtacagacatccaagtatgcagacttgggcaacaccttcgctccgatgacggtcgaagatcgtgccctcatccaacgctacatagagcagggctacgacctcttcctcactcgcgtatcggaaggccgcaaccgcaccaaggcacagatcgacagcatcgctcaaggccgtgtatggctcggcgacaaagctcttgcactcggtttggtggatgagcttggaggtttggacacagctatcaaacgggccgcgaagctggctcagctcggtggcaactacagcatagagtatggcaagaccaagcgcaacttcttcgaagagttgctctcctcatcagcagcggatatgaagtctgccatcctgagtaccattctctccgatccggaaatagaagttctgcgcgaactccgctccatgccgccccgtccttcgggcatacaggcacgtctcccctattacttcatgccgtac

SEQ ID NO: 136 - DNA, 939 bp, Porphyromonas gingivalis
atgagagcaaacatttggcagatactttccgtttcggttctctttttcttcgggacagcgatcggacaggctcagagtcgaaaccgtacatacgaggcttatgtgaaacagtacgccgacgaagctatccgacagatgagccgctacaatataccggcaagcatcaccatagcacaggctttggtggagacaggagccggagccagtacactggccagcgtacacaacaatcacttcgggatcaaatgccacaaatcgtggacgggcaagcgcacctatcgtaccgacgatgcgccgaacgaatgcttccgcagctattcggccgctcgcgaatcgtatgaagatcattcccgatttctgctccaaccacgctatcgtcccctgttcaaactcgacagagaagactatcggggctgggctacggggttgcaacgctgtggctatgccaccaatcggggctatgccaatctgctgatcaagatggtggagctgtatgagctatatgctttggatcgcgagaagtacccctcatggttccacaagtcttaccccgggtccaacaaaaaatcccatcaaacgaccaagcagaagcagagcggactcaagcacgaagcttacttcagctacggactgctctacatcatagccaagcaaggcgataccttcgattctttggccgaagagttcgacatgagagcctccaaactggccaaatacaacgatgctcccgtggatttcccgatcgaaaagggcgatgtgatctatctggagaaaaagcacgcatgctccatctccaaacacacacagcacgtagtgcgtgtgggcgattcgatgcacagtatctcccaacgctatggcatccggatgaagaacctctacaagctcaacgacaaggatggcgaatatataccccaagagggcgatatactgcgcttgcgc

SEQ ID NO: 137 - DNA, 1569 bp, Porphyromonas gingivalis
atggacggacgtcgatattcggatggcctccatcaggctatcgaagccaaagagcatgtgaaagtagaggctgcgacacagacatttgcaactatcactttgcagaactatttccgcatgtatcataagctggcagggatgaccggtactgctgaaactgaagcgggagagctttgggacatctacaaactggacgttgtagttattccgacaaacaagcctatcgcccgtaaggatatgaatgatcgtatctataagacggcacgtgaaaaatatgcagcagttatcgaagagattgtacgtcttgtcgaagagggcagacctgtacttgtcggtactacttcggtggaaatatccgaattgttgagccgtatgttacgcttgcgtggcatccaacacaatgtactcaatgccaaattgcatcagaaggaggccgagattgtagctcaggccggtcagaaaggaactgttaccatcgcaacgaacatggccggtcgtggtaccgacatcaagctctctgccgaggttaagaaagccgggggtttggctatcattggtacggaaaggcacgaatccagacgagtggacagacagcttcgtggtcgttccggccgtcagggtgatcccggttcgtccatattctatgtttcccttgaagatcatctgatgcgcctctttgccacagaaaagattgcatcattgatggatcgtttaggtttcaaggaaggagaagtgctcgaaaacaacatgctgagtaagtccgtggagcgtgctcaaaagaaggtggaagagaacaacttcggtatccgtaaacatctgcttgagtacgatgatgtaatgaattcgcagcgtgaagtcatttatacccgtcgccgtcatgctttgatgggagagcgtatcggtatggatgtactcaataccatatacgacgtatgtaaggctctgattgacaattatgcagaagccaatgatttcgaaggcttcaaggaagatctgatgcgtgcactcgcgatagaatctcctatcacgcaagaaatattcagaggtaagaaagcagaagagctgaccgatatgcttttcgatgaagcttacaagtctttccaacgtaagatggatctgatcgcagaagtggcccaccctgtggttcatcaggtattcgagacccaagccgccgtgtacgagcgcattctaatccccattacggatggtaaacgtgtctataacataggatgcaatttgcgtgaagcggatgaaactcaagggaaaagcatcatcaaagaatttgagaaagctatcgtactgcatactatcgatgagtcttggaaagaacatctgcgtgagatggacgagcttcgtaattccgttcagaatgccagctacgaaaacaaagatccactacttatctataaactcgaatcttacgaactgttccgcaagatggtagaagccatgaaccgtaagaccgtagcgatcctaatgcgtgctcggataccggtaccggaggctccttcccaagaagagctggaacacaggcggcaaatagaaatccgacatgcaacccaacaacgt

SEQ ID NO: 138 - DNA, 1125 bp, Porphyromonas gingivalis
atgaatttcttaaaaaaagaaccgtttaaaatattctctatgatttatctgctgttagatacaataacaaaccgtgccggtacagaacgcgccgtgatcaacttggctaacaacctgcatgccaatggtcatcgcgtatcattagtcagcgtttgtacaaaagaaggagagccttccttccaagtagaaaaaggaatagaagtacaccatctcggaattaggctttatggcaatgcattagcccgcaaaacagtatatttcaaggcttatcgaaggataaaagccctatacaagaagcgtgaaccggttttattgatagggactaatatttttatcaatacaattttgtctcagatcagtaacagaggcagaatatttacgatcggatgcgaacatatctcttatgatattgcccgccctattacaaaacgcataagggggtttctgtattcagggcttgatgccgttgtagcactgacaaaaagagatcagcaatcgttcgaggcaatcttacgtggacgctctaaagcatatgtcatacccaatcaagtttcatttactacagtccaaagagatgctactactcacaaacaaatgttggcgattggcaggcttacctaccagaagggttttgaattcatgatagaagatgcatcacgagtgctgcgagaaaggcctgattggaagcttatcatagtcggagatggcgaaaatgaatcgatgctacgtaaagaaattgcatctcgcaatatggagtcgcaaatagaaatacatccatctacaccggaaattcgcaaatactacgaatcatctgctatttatctaatgacgtcccgtttcgaaggactaccaatggtacttctcgaagcagaagcatatgcactacctataatctcatacgattgtccgaccggcccgagggaactgatcgaaaacggtcgcaatggtttccttgtgccaatggaagcacatgaagacttcgcggataagttacgcttattgatggatgatgaaactcttcgtaagaaaatgggacaagaatcagagttgatggtcaaatcctactctccggcaaatatctatgaatgttggaagaaactattcgtcgaaatcggctacatgaat

SEQ ID NO: 139 - DNA, 1086 bp, Porphyromonas gingivalis
atgatttatctgctgttagatacaataacaaaccgtgccggtacagaacgcgccgtgatcaacttggctaacaacctgcatgccaatggtcatcgcgtatcattagtcagcgtttgtacaaaagaaggagagccttccttccaagtagaaaaaggaatagaagtacaccatctcggaattaggctttatggcaatgcattagcccgcaaaacagtatatttcaaggcttatcgaaggataaaagccctatacaagaagcgtgaaccggttttattgatagggactaatatttttatcaatacaattttgtctcagatcagtaacagaggcagaatatttacgatcggatgcgaacatatctcttatgatattgcccgccctattacaaaacgcataagggggtttctgtattcagggcttgatgccgttgtagcactgacaaaaagagatcagcaatcgttcgaggcaatcttacgtggacgctctaaagcatatgtcatacccaatcaagtttcatttactacagtccaaagagatgctactactcacaaacaaatgttggcgattggcaggcttacctaccagaagggttttgaattcatgatagaagatgcatcacgagtgctgcgagaaaggcctgattggaagcttatcatagtcggagatggcgaaaatgaatcgatgctacgtaaagaaattgcatctcgcaatatggagtcgcaaatagaaatacatccatctacaccggaaattcgcaaatactacgaatcatctgctatttatctaatgacgtcccgtttcgaaggactaccaatggtacttctcgaagcagaagcatatgcactacctataatctcatacgattgtccgaccggcccgagggaactgatcgaaaacggtcgcaatggtttccttgtgccaatggaagcacatgaagacttcgcggataagttacgcttattgatggatgatgaaactcttcgtaagaaaatgggacaagaatcagagttgatggtcaaatcctactctccggcaaatatctatgaatgttggaagaaactattcgtcgaaatcggctacatgaat

SEQ ID NO: 140 - DNA, 1920 bp, Porphyromonas gingivalis
atgggaaaaatcattggaattgacttaggcacaacgaactcttgtgtctctgtattggaaggtaacgaacctatcgttattacaaacagtgagggcaagcgcacaacgccctcggtagtggcttttgtggatggtggcgagcgtaaggtgggcgatccggccaagcgtcaggccatcaccaatccgaccaagacgatatactctatcaaacgcttcatgggcgaaacttacgatcaggtttccagagaagtggagagagtgccattcaaggtagtacgtggggacaataatactccgcgcgtagatatagacggtcgtctctatacgccgcaggaaatttcggccatgatccttcagaagatgaagaagacggccgaagactacctcggtcaggaagtaacggaggccgtgatcactgtgcccgcatacttcaacgacgctcaacgtcaggcaacgaaagaagcaggagagatcgccggcctgaaagttcgccgtattgtgaacgagcctacggcagcttctctggcctacggtctggacaagtccaataaggatatgaagatcgctgtcttcgacttgggtggcggtaccttcgatatctctatcttggaattgggcgacggcgttttcgaagtgaaatcgaccaacggtgatacgcacctcggaggagacgacttcgaccacgtgatcattgactggctggcagaagagttcaagtctcaggaaggtgtggatcttcgccaggatcctatggctatgcagcgtctgaaagaagctgccgaaaaagccaagatagagctctccagcacttcatctacggagatcaacctcccctatatcatgccggtgaacggcatccccaagcacttggtgatgacgcttacaagggctaagttcgagcagttggccgatcgtctgattcaggcatgtgtggcaccctgcgaaacggccttgaaagatgccggtatgtcacgtggcgatatcgatgaagtgattctcgtaggtggttccacacgtattcctgctattcaggagattgtggagaagatcttcggtaaggctccgtccaagggtgtgaatcccgacgaagtggtagctgtgggtgccgctattcaaggcggtgttctgaccggtgaggtaaaggatgtcttgctgttggacgttacccccttgtcgctcggtatcgagactatgggaggcgtgatgactcgcttgatcgatgccaataccactatcccgacgaagaagagcgaaatctttaccacagcagtggacaatcaaccttcggtagagattcatgtacttcagggtgagcgttctttggctaaggacaataagagcatcggccgtttcaacttggacggtattgctccggcgccccgtcagacaccgcagatcgaagtaacgtttgacatcgatgccaacggtatcctgaatgtaacggctcatgacaaagctaccggcaagaagcagaatatccgcatcgaagcctccagcggtttgtccgatgatgagatcaagcgcatgaaggaagaggcgcaggccaatgccgaagcagataagaaagagaaagaacgtatcgacaagatcaatcaggccgacagcatgatcttccagacggaaaagcagttgaaggagttgggagacaaattcccggccgacaagaaggctccgatcgataccgctctcgacaaactgaaagaagcacacaaagcacaggatgtagctgctatcgatacagccatggccgaactgcaaaccgctctttccgcagcgggcgaagagctttacaagaatgccggagcagcccaaggtggcgcacaacccggtccggacttcggcggtgctcaaggtccctctgccggtgatcagccctctgacgacaagaacgtcacagacgtagacttcgaggaagtgaag

SEQ ID NO: 141 - DNA, 1347 bp, Porphyromonas gingivalis
atgcgctacgacttagctatcatcggtggagggccggccggttatacggctgccgaacgtgctgccaaaggtggcctgaaaaccctcctaattgagaagaatgctctcggtggtgtatgcctcaacgaaggatgtataccgaccaagacgctactctactcggccaaagtgctacatcaaattgctacggcatctaaatatgcagtaagtggaacggccgatggacttgacctcggcaaggtgattgccagaaaaggtaaaatcattcgcaagctgactgcaggcatccgttcacgcctgacagaggccggagtagagatggtgacggcagaagctaccgtaacgggatgcgatgcagacggcatcatcggcattactgcgggcgaagcacagtacaaagctgccaacctgctactatgtaccggttcggagacgtttattccacccatccccggagtggagcagacagagtattggacaaaccgtgaagctctacagaacaaagagattccgacctctctcgtcatcatcggtggtggagtgatcggaatggagttcgcttctttcttcaacggtatcggtacgcaagtgcacgtggtggagatgctgccggaaatactcaacggtatcgatcccgaacatgcagctatgctacgcgctcactatgaaaaagaaggaatcaaattctacctcgggcacaaagtaacatcggttcgcaacggagctgttacggtagaatacgaaggagaaagcaaagagatcgaaggagaacgtatcctgatgagtgtgggacgtcgccccgtgctgcaaggattcgagtcgctcggattggtgcttgccggcaaaggtgtaaagactaatgagaggatgcaaacttccctgcccaatgtctatgctgcaggtgatattacaggcttctcgcttttggcacatacggctgtacgggaagcagaggtagcagtagatcagattttgggcaaaacagacgaaacgatgagctaccgtgccgtaccaggtgtggtgtacaccaatcccgaggtcgccggtgtgggagagacggaagaatcgcttcgcaaagcaggacgtgcctacactgttcgtcgccttcctatggccttctccggtcgatttgtagcagaaaacgaacaaggcaatggagagtgcaaactactacttgatgaagagaaccgcttgatcggagcacacctcattggcaatccggccggcgaactcatcgtaaccgctgccatggccatcgagaccggcatgacggatcgacaaatcgaacgaatcatattccctcatccgactgtaggcgaaatcctaaaagaaactctcgccggaggt

SEQ ID NO: 142 - DNA, 2823 bp, Porphyromonas gingivalis
atggaattgaaaagatttttatcacttggtcttctgcttgtgggattcattccgatgaagctttctgcccaacaggctcagccactccctacagatccggctgttcgtgtcggtaagttggacaacggattgacttatttcatccgtcacaacgagaacccgaaagatcgtgcggatttctttatcgcacaaaaggtaggttctattcttgaagaagatagccagtccggtttggctcacttcttggaacacatggctttcaacggtacgaagaacttccccggtaagaacttgatcaactatctcgaaacgatcggtgtacgtttcggtcagaacctgaacgcttctaccggattcgacaagacggaatatacgataatggatgtgccgactacacgtcagggaatcatcgactcctgcttgcttatcctgcatgattggagtaacaatattaccctcgacgggcatgagatcgacgaggagcgcggtgtgatccaggaagagtggcgtgctcgtcgcgatgccaaccttcgtatgttcgaggctatacttgccaaggctatgccgggtaataaatatgcagaacgcatgcccatcggtctgatggacgtcgtgctcaacttcaagcatgatgagctgcgcaactattataagaaatggtatcgtcccgacctgcaaggtctggtgatcgtgggagatatcgatgtggactatgtggagaacaagatcaaagaactcttcaaggacgttcctgctcccgtgaatccagcagagcgtatctatacgccggtagaggacaacgatgagcctatcgtagccattgctaccgatgctgaggctactaccacgcagctctccatcagcttcaagagcgaccccactcctcaagaagtgcgaggatcgatattcggacttgtggaagactatatgaaacaggtgatcactacagccgtgaatgagcgtctgtccgagattactcacaagcctaacgctcctttcctcagtgcaggagctttcttctctaacttcatgtacatcacccagactaaggacgcattcaattttgttgccacggttcgtgagggtgaagcggagaaagcgatgaacgcattggtggcagagatagaaagcctccgtcagttcggtatcaccaaaggcgaatacgatcgtgcacgcacgaatgtgctcaagcgatacgagaatcaatacaacgaaagagacaagcgtaagaacaatgcttatgccaatgaatactccacctacttcaccgatggcggctatatcccgggtattgaggtggaatatcagacggtgaatgcttttgctcctcaggttcctctggaagcattcaatcaggctattgcccaaatgatcgatccggtgaagaatgctgtcgttaccctcaccggtccttcaaaggctgaagccaagattccgagcgaagcagacttcctcgctgctttcaaagctgctcgtcagcagaaagtagaagccaagaaagacgaagtctccgaccaaaaattgatggagaaagctcctaaggccggaaagatcgtttccgagaagaaagatcagaagttcggtaccacggaacttacccttagcaatggcatcaaagtatacctcaagaagaccgatttcaaatcaaacgaaatcctgatgagtgctctcagcccgggtggtatcctctccggaaagcatgctcccaaccaatctgtgatgaattcgttcatgaacgtgggtggcttgggcaacttcgatgctatccagctggataaggtgctgacaggtcgctctgcttccgtatctccctctttgtctctgctcagtgaaggtctttcgggcaaaacgactgtagaagatatggaaactttcttccagttgatctatctccaaatgactgctaaccgcaaggatcccgaagcgttcaaggccacacaggaaaagttgtacaataacttgaaaaatcaggaagccaacccgatggctgcgcttatggactctatccgtcataccatgtacggcgataatccgatgatgaaacccatgaaagctgctgacgtggagaaagtaaattacgatcaggtaatggctttctacaatgagcgattcgctgatgccggcgactttatgttcttctttatcggtaatctggatgaagccaagatgaagccattgatcgaaacttatcttgcttcattgcccaacctcaagcgtggcgataagatgaataaggctcaggtaccggctgcccgttcgggaaagatcgattgcaagttcgagaaggaaatggatactccttcgactactatattcgatgtcgtgtccggaaatgtggaatatacgctcaagaacagtctcctgctggaagtcttctcagccgtaatggatcaggtgtacacggctaccgttcgcgagaaggaaggcggtgcatacagtgtggctgcattcggcggtctcgagcaatatcctcagcccaaggctctgatgcagatctatttccccacggatcctgctcgtgccgaggaaatgaatgctatcgtttttgctgagttggagaagcttgccaaggagggccccaatgtggaatactttaagaagactatcgaaaacctgaataagcagcacaaagaaagtctgcgtgagaatcgtttctggctcgaagccatgaaggcgtctttcttcgaaggaaatgacttcatcacagactacgaatccgtactgaacggtcttactcctgctgaattgcaaaagtttgcggcagacctcttgaagcagcagaatcgggttgttgtcatgatggctcctgttgcaaaggctcaa

SEQ ID NO: 143 - DNA, 2052 bp, Porphyromonas gingivalis
atgagtaagaaaggaacaatcggggtaacgagcgacaatatattccccgtcatcaaaaaattcctgtacagcgaccatgagatattcctgcgtgagatcgtctccaatgccgtggatgctacgcagaagctgaaaacgcttacatccgtcggcgaattcaaaggcgagacgggtgacctccgcgtaacggtcagcgtggatgaagtggcacgcacgatcacggtcagcgaccgcggcgtagggatgaccgaagaggaggtggagaagtacatcaatcagattgctttctccagtgcggaagagtttcttgaaaagtacaaagacgacaaggccgccattatcggccacttcggactcggattttactcggctttcatggtgtccgagcgagtggacgtgatcacgcgctctttccgagaagatgctacggcggtgaaatggagctgcgacggatcgcccgaatacacgctcgaacctgcggacaaggctgaccgtggcaccgacatcgtgatgcacatcgatgaggagaatagcgagttcctcaaaaaagaaaagatagaggggctcctcggcaaatactgtaagttccttaccgtgccgatcattttcggcaagaagcaggaatggaaagacggcaagatgcaagatacggacgaggacaatcagatcaacgacacacatcctgcctggaccaaaaagcctgccgacctcaaggacgaagactataaggaattttaccgttcgctctatcccatgtccgaagagcctctcttctggatccacctcaatgtggactatccgttcaatctgacaggtatcctctatttcccgaagatcaaaaacaacttggatctgcagcgcaacaagattcagctctactgcaatcaggtttacgtcaccgatgaagtacagggtatcgtgccggacttcctcaccctcctgcacggggtcatcgattcgccggatattcccctcaacgtatcgcgctcctatctgcagagcgatgccaatgtgaagaagatctcgtctcatatcaccaagaaggtggcagaccgtctggaagaaattttcaaaaacgaccgccccacattcgaggagaaatgggatagtctgaagctcttcgtcgaatacggtatgctgacggatgagaagttctatgagcgtgcagccaaattcttccttttcaccgatatggacggacacaagtacacgttcgacgaataccgaacgctcgtcgaaggtgtacagacggataaggacggacaggtagtgtatctctatgctacggacaagcatggacagtacagccacgtgaaacgtgcatccgacaaaggctacagcgtgatgctgttggatggtcagttggatccgcatatcgtgagcctgctggagcaaaagttggagaagacacactttgtccgtgtcgatagcgatacgatcaacaatctgatccgcaaggaggaaagagccgaagtgaaactgtccgatacggagcgcgccactctcgtgaagctgttcgaagcacgcctgccacgggacgagaagaagcacttcaatgtagctttcgaatcgctcggagccgaaggtgaagccatccttatcacacaagccgaattcatgcgccgtatgcgcgatatggcacagctgcagccgggaatgagcttctacggcgaactccccgattcgtacaatctggtacttaataccgatcatccgctcatcgacagggtactctccggtgagaaagaatcggtagagccttcgctcacagagcttagagcgaaaatcgccgagctgaaagcggaagaggccaagctgctcgatgaggaaaaagggaagaaaccggaggaaatccctgttgccacgaaggaagccaaggagaacaacgccgtcgaacaggccaaaaccgaaggcagtatcaacgatcaactgaccaaatatgctcaggacaacgagctgataggtcagctcatcgacttggctctgctcggaagcggattgctgacgggagaggctttggccgaattcattcgtcgcagccagcgtcttctc

SEQ ID NO: 144 - DNA, 1392 bp, Porphyromonas gingivalis
atggaaaaactgatcgatattttggtcgtagacgatgatgtggcagtctgtgccgcactgcgtctggtgctcaagcgagcgggctataatcccgttatagccaacagtcccgacgaagctttgtccataatgcggaatcctgatggcggctgtaagccggctgtgattctgatggatatgaatttctccctttcgacctccggcagggaaggattggaactactggagaagatgcagatattcacttcctgccctgtcatactgatgacggcttgggcttcgattccactggcagtggagggaatgaggcttggagctttcgacttcataggcaagccatgggacaacgatcggctccttcgtaccatagatacggccttgcatctggctgctccctcagctgtggcgaatccatcggaacagtctgacagagatacagcccgtcagccgaaagctacagtccaagagaatgacccctgtgcccatatcataggccggagcgatgccatctgtaagatcaaggaacggatacgccgcatagctcccacccatgcctctgtgctgatcacgggcgagagcggtacgggcaaagagttgatagccgaagctctgcaccgtgggagcaaacgagcctcagccccattcgtcaaggtcaatttgggtgggattcccgaaagtttgttcgaaagtgagctgttcggacataagaaaggagcttttaccaatgctttttccgacaggaaaggacggttcgagctggctgatggcggcacgatctttctggacgaaataggcgaactaccggtcggcaaccaagtaaaactgctgcgagtgctacaggaacagacattcgagccgttgggcgagagcgtctcccaccgagtggacatccgtgtggtatcggctacgaatgcttccttggagcgaatggtagccgaaggacgtttcagagaggacctctactatcgaatcaacctgatacatctgcatctgcctccgctgcgtgagcgtcaggaggatatacagctgctggtggaagccttcagtgaagcctttgcccaatcgaacggattgccccatgccgtttggagtgcggaagctatgcgacgtatctgtgccatgcccctaccgggcaatgtacgcgaactgaaaaacgtagtggagcgtacgctattgctctcgggatcgagagaaatcagtgcccgggatgtggctgacttcggttcgcaggtgacggcagcagaccactccgacgaacgggctttgaccgacatggaggaagctgctatccgagagacgctgactaaatacaacggcaacgttagtcgtgctgcacgagccttgggattgagccgggcagctctttaccggcgaatggagaaatacggactg

SEQ ID NO: 145 - DNA, 750 bp, Porphyromonas gingivalis
atgcttaagataaagaacctccacgccacagtacagggcaaagagatattgaaaggaatcaatctggagatcaatgccggagagattcatgctatcatggggccgaacggatcggggaaaagtacgctctcttccgttttggtgggacatccctcctttgaagtcacggaaggagaggtgacattcaatggaatcgacctgctcgaactcgaaccggaagaacgtgcacacctcggactctttctcagtttccaatatccggtcgagatcccgggcgtcagcatggtgaatttcatgagggcagctgtcaatgaacataggaaagcgatcggagcagaacccgtatcggcaagcgacttcctcaagatgatgcgagagaagcgtgccattgtggagctggacaacaaattggccagccgttctgtgaacgaaggcttctccggtggagaaaaaaagaggaacgaaatcttccaaatggctatgctcgaacccaagctggctattttggacgaaaccgatagcgggctcgatatcgacgctctccgcatcgtagcaggcggggtaaaccgactccgctctccggagaatgctgctattgtgatcacacactatcagcgtttgctcgagtacatcaagccggacttcgtacacgtcctttacaaggggcgcatcgtcaagtcgggaggagccgagctggctctcacgctcgaagaaaaaggctacgactggatcaaggaagagataggagaa

SEQ ID NO: 146 - DNA, 1383 bp, Porphyromonas gingivalis
atggctaaggagaaaacgatctacgtctgccgttcgtgcggaaccaaatacgccaaatggcaaggcaactgcaatgcctgtggagagtggaactgcattgatgaggagaaggtgccggcaccggcatcgggcaagcatgcagccaagagttttatgcctcgggagcaggacaaccggccaagactcttacaggatgtggagtccggcgatgaagagcgtattcgcctcggcgatgaagagttcgaccgcgtactgggtggaggaattgtcaaaggagcatttgtcctgcttggcggcgagccgggaatcggtaagtccacgcttatcctccagacggtgctgcgtctgccgcagttgcgcacgctctatgtgtcgggcgaagaaagtgcccgacaactgaagatgcgcgccgaacgactggggcaagccatgaatgggtgctacgtatactgcgaaacgaatatagagaggatactctcccgtgcagaagaactcacacccgatctcctcgtgatagactctatacagacggtctataccgaggaaatggaaagctcggccggcagcgtggggcagatccgcgaatgtgccgccttactgctcaaatactgcaagactacgggtatccccgtcatcgtcatcggacacatcaccaaagaaggtagcatagccggaccgaaggtgctggagcatatagtggatacggtgcttctcttcgacggggataagcatcatctctaccggatactccgaggacagaagaaccgctatggcagtacttccgagctggggatatacgagatgcggcaggacggtctgcgtggcgtggagaatccgagcgaacatctcatcacacgcaatagggaagacctcagtggcatagccatagccgtagcgatggagggcattcgcccgatactcatcgaagcgcaggctttggtcagctcggccatttatgccaatccgcagcgttcggccacgggcttcgatattcggcggatgaacatgctcttagccgtactggagaaacgtgccggcttcaagctcatacagaaggatgtgtttctgaacattgccggaggtatcaaaatagccgatccggctacggatctggccgttatctcggcagtgctggcgtcgagtctggacatcgttatcccgccggccgtatgcatgacgggcgaggtcggactctccggagagatacgtcccgtgagccgcatcgagcagcgcataacggaagcgcgtcgcatagggttcaaagagatattggtaccggccgataatttccggcaggaggatgccggccgcttcggtattcggctcgtgccggtcagaaaggtggaggaagccttccgccatctgttctcgaaaggaagagaa

SEQ ID NO: 147 - DNA, 813 bp, Porphyromonas gingivalis
atgaatagcagacatctgacaatcacaatcattgccggcctctccctctttgtactgacattgggcggctgctccgtagcccaacaagatacgcagtggactctcggcggaaagctctttacttcggcgtggatacaacgttcggccgaatatcaagcgctttgcattcaggcatacaacatcgctacggaaagagtggacgctctaccggcagaacgtaaacaaggagataggccttatgccatcgtaacggacatagacgaaaccattttggacaatacgcctaactccgtgtatcaggctctcaggggcaaggattatgatgaagagacttgggggaaatggtgtgcacaggccgatgccgacacactggcaggagctttgtctttcttcctccatgcagcgaacaaggggatcgaggtcttttacgtcaccaaccgcagagacaatctgcgcgaagcaactcttcagaaccttcagcgttacggattcccctttgccgatgaagaacatttgcttacgacccatgggccatccgacaaagaaccccgtcggctcaaaatacaagaacagtatgaaatagtattgctcataggagacaacttgggcgacttccaccacttcttcaatacgaaagaagagtccggacgcaaacaggctctgggcctgacagccggggagtttggccggcacttcatcatgctgcccaatcccaactacggatcttgggaaccggcatggtacggcgggaagtatccgccactgcccgaaagagacaaagcacttaaacaactgcactcacagaacagcaga

SEQ ID NO: 148 - DNA, 1251 bp, Porphyromonas gingivalis
atgagcaccaatatagatgtacaacagatcaaacagcgtttcggcatcatcggtagcagtccgctgatggaacatgccatacgagtggcagcacaggtggctcctaccgacatgtccgtcctcgtgacgggggagagcggttcggggaaagagttcttcccacagataatccactactacagcgcccggaaacatcatagctacattgcagtcaattgcggagccatccccgaaggaaccatcgattccgagctgttcggacaccgcaaaggttcctttaccggagccgtatcggatcgcaaggggtacttcgaagaagcatccggcggcacgatctttctggacgaagtgggcgaactgcctttgcccacgcaggcgaggctgctgagggtgctggagacgggcgagttcatccccgtaggagccagccagtcgcagaagacggatgtccgtatcgtagcggcgacgaatgtgaacctcaaggaggcggtagcgaacgggaagttccgggaagacctcttcttccggctcaatacggtaccgatcgaggtgcctgcgctgcgtatgcgaccggacgacgtgcccttgctttttcgccgattcgccgccgacagcgccgagaagtatcggatgcctccgctgcgcctatcggacgaagcccgtaccatattaatgcgttaccgctggcccggcaatgtgcgagagctgcgcaatataaccgacaggctgagcatcctggaggaggagcggacggtatcggcagagaccatcactcgctacctggacgctgaggggatgcaagacctccaccccgtcgtgatccgacggaacgaaacgaccgaagcggacaaacaaatcccccattacgagcgcgaaatcatctaccaggtgctatacgatatgaagaaagagatagccgatttgaaggggatgatgaaccgcctggcgcaccacgaacagccctcatggcctgtagggtcggacgtctggggcaacgacgacaagcgcaccgcagatccgaagtggggcgtcagcacgcacaaggcccccatcgcgaacgcggcagaacccgtggagccgatacaggaagccagcgaatacaccgaggatccggtttcgctggaggaggtagagaagaaaatgatttcccttgcattggaacgccacggcggaaggcgcaagcagacagccgaggaactgaagatttcggagcggacactataccgtaaaatcaaggagtatggactggaa

SEQ ID NO: 149 - DNA, 1806 bp, Porphyromonas gingivalis
atgatcctactcttcggcggtactacggaaggccgtgccgcagctcgcgtgctggatgaagcgggaagtccgtttttctactccaccaaaggcaatctgcaagagatccagagtagccacggccatcgtctgacaggagccatgacggttgccgacatggtttcgttttgtcggaaagaagagatccgactgatcgtggacgccgctcatcctttcgccgaagaattgcacgcttcagtggcagaagcctctgaacaaacaggtatccccgtagtaagatacgagagacaataccctccacgcgaagaaggtatcgtctggtgtgcaaactacgatacggctgccgagcggatgcttggcgatggcgtgcagcgtctgctgatgctcacaggagtgaatacgatccccaagctggctgctttctggaaagagcgcaccaccttttgccgcatattgaagcgagacgaatcggttgctttggcagagaagaacggctttcctgcggagcgcatcgttttcttcgaaccgcatgcggacgaggagctgatgcaagccgttcgccccgatgccattatcacaaaagaaagcggagagagcggttacttccgagaaaagatagaagctgcccgacggatgggcatccgtatatatgccgtcgtacgtccccctttgcctccttcattcattcccgtaggcgggcctgtcggtttgagacgggcggtagaacgcctcgtgccgggattcttttcactccgaagcggattcactaccggcaccacagctaccgctgcagtagtagcagccatgtaccgattgatggggcttggctctctcgccgaagctcccgtagaattgccttcgggcgaaatagtcagtctgcccatagcggaaattcgagaggaagaagatgctgtcgtatccgcagtcctgaaagatgcaggtgatgatccggatgtgaccaatggcatggcggtatgcgctacgatcaggctcaatcccgaacatgaggaagtccgcttcctgcagggtgaaggggtgggggtagtgacgctccccggcctcggtctggaggtcggaggtccggctatcaacctcgtacctcgacgaatgatgacagcagaggtacgccgactctatgcgcagggaggtgtggatattacgattagcgtacccgaaggccgagaggctgctacccagacattcaatccccgactcggcatacgggacggcatctctattatcggaacatcgggagtcgtgaaacctttttcggccgaagcgttcgttggtgccatccgtaagcaagtgggtattgccaccgccttgggagccaatcatatcgtcctcaattcgggagccaagagtgagcgttatgtaaaaggagcctatccggcactcattccacaggcctttgtgcagtatggcaatttcgtcggcgaatcactcagttgtgtagcttccttcccttctgtccgttcggtaacggtaggaatcatgctcggcaaagcagtgaaactcgccgaaggctatctggatacgcacagtaaaaaggtagtgatgaatcgggatttcctgcacgaactggctcgtcaggcaggttgttcggaagacatccatgccataatagacagcctgaatttggctcgtgagctatggactatgccgagtgcggaggacagcgatcgactgctacgaaagattgccgaacgatcttgggaaacttgccgcccatcggtaccatcggccgaattagaactcctgctgatcgatgagtccggagcgattcgttttcgtatcggtggagaa

SEQ ID NO: 150 - DNA, 1329 bp, Porphyromonas gingivalis
atgttgaggactttccgaatcggtggtattcacccccccgaaaacaagttgtcggcaggcaagcccgtagaggtgttgcctatcccctcacaggtagtcatccctcttggtcagcacatcggtgcaccggcaactgccacggtcaagaaaggggatgaagttaaggtcgggactatcattgctcaggccggaggattcgtatcagctaatatccactcatctgtgtcgggtaaggtgctgaagatcgataacgtatacgactcaagcggctatcccaagcccgcagtcttcattagcgtagaaggtgacgaatgggaagagggcatcgatcgctcaccagccatcgtcaaagaatgcaatctggatgcaaaagaaatcgtagccaaaatttctgcagccggtattgtgggtcttggcggtgctaccttccctacccatgtgaagctgtcccctcctccgggcaacaaagctgagatcctgatcatcaacgccgtagagtgcgagccttatctgacgagcgaccatgtccttatgctggagcacggcgaagagatcatgatcggcgtgagtatcctgatgaaagccattcaggtaaacaaggccgtcatcggagttgagaataataagaaagatgctattgctcacctcaccaaactggccactgcatatccgggcatagaggtaatgccgttgaaggtgcaatatcctcaaggcggtgagaagcagctgatcgatgcagtgatccgcaagcaggtaaaaagcggtgccttgcctatcagcacaggtgccgtagtacaaaacgtgggtacggtattcgccgtgtacgaagcagtacagaagaacaagcctctggtcgagcgcatcgtgacggttacaggaaaaaaactgtctcgtccgtctaacctcctcgttcgtataggtactcctattgcggctttgatcgaagcagcaggtggcttgccggagaatacgggcaagatcatcggcggaggtccgatgatgggacgcgctctgctgtcaccggatgtgcctgtgaccaaaggcagctccggagtattgattctcgatagagaagaggcagttcgcaagcctatgcgcgactgtatccgatgcgccaagtgcgtcggagtgtgtccgatgggactcaatccggctttccttatgcgcgacaccttatataagagctgggaaacagcggaaaaaggcaacgtggttgactgtatcgaatgcggttcgtgcagcttcacctgtccggccaaccgtcctctgctggattatatccgccaagccaagaagactgtgatgggtatccaaagagcacgtaagcaa

SEQ ID NO: 151 - DNA, 1437 bp, Porphyromonas gingivalis
atgaaaagaatacaactaactcttatcgctctcttcgccgctgttgccggtttggtcgctcaaaatgcttacgagggagtaatttcatataaaatttcgttggacaaaaccggaaacaaggttgtactgaatggtgcggcagatatgagtaatttaaagctcaagagcactcagatgatcattgttacgcctattcttcgttcagaagatggtaccagccgggtggaatttccttcggtagtcattacaggccgcaatagaacaaaagctctcaagcgtgaaatcgcatttagttcggctttgccccaagcaaaacatgcagctcaatacattcgccgtcataatgggaagagcgagcagtttgcttttacaggagaacatgcttatgcatcatggatgatggatgccaagtttgtggttcgtgaggaggtacgaggttgtgctaaatgccctgtaggtctctcgagtaatattgttccttttgatccactcttcaatccggcagaggctccttatttgttggcacacattactccggcagaagaagtggaaaaacagcgagagtccagcttcgatgcttatatcaacttcaaagtcaataaggcagatgtccttcctgagtatcgcaacaataaggcggagttagagaaaatcaaagaatttgtaagcaccgttaaggctaatccaaactattcggtcaataaaatgatcatcgaagggtttgcttctcccgaggcttcaatagcccacaataaggctttgtcggagcgccgtgctaaaagactcgcggaagaattggtgcgtaagtatggcaaaacattgccgaatataaccactgaattcggcggtgaagattggaaggggctgaaactggctatcgaaaagagtgatatagccgatcgtgaccgcgtattggagataatcaactccgataaatatgccgatgatgatgcacgtgaacaggctctgaagcaactttcgtcttatcgttatatcttggatcagatctatccgaatttgcgtcgcaatacgataaccatggggtatatcgttcgtgattataccctcgaagaagctcgtgaaatcattaagactgctccgaaagaacttagtgaggccgaaatgtaccgtgtggcaatgtcttatcctgaggggcaccaagagcgtttgtttgctctgaatacgacccttaagtatttccctgaaagtgtaacgggccgaatcaatttggctgtagccgcttttaatggtggagacgttcaacaggcaattgctctgttgagtccgattcagacagaaaagggtgtaagcaatatccttggagctgcttatgctcgtacgggagattttgctcgtgccgaaaccttcttccgtaaggccgttgcagaaggagatgcaaatgcgcagcgcaacctcgatatgctgcttggcaaaaag

SEQ ID NO: 152 - DNA, 1149 bp, Porphyromonas gingivalis
atggcagaaaaaagagactattacgaagtcctcggtgtatcgaagaatgccaccgacgatgaactgaaaaaagcatatcgcaagaaggctatccaataccatcctgataagaaccccggtgacaaggaggccgaagagcacttcaaagaggtagctgaagcctacgacgtattgagcgatccgcagaagcgcagtcaatatgaccagttcggccatgccggattgggcggagctgccggtggaggtttcagcggaggcggtatgtccatggaggatattttcagtcgcttcggtgatctattcggtgggttcggcggtttcggcggattctccgatatgggcggtggcagtcgcagacgtgttcgcagagggtctgacctgcgagtacgagtgaagctttctttggccgatataagtaaaggtgtggagaagaaagtgaaggtaaaaaagcaggtagtgtgcagcaaatgtcgtggcgatggcacggaagaagccaatggcaagactacctgccagacctgccatggaaccggcgtggttacacgtgtgagcaacactttccttggggccatgcagacccagagcacttgtcccacttgccacggagagggtgagatcatcacgaagccatgctccaagtgtaagggcgaaggtgtggagatcggcgaagaggtgatctcattccacatccctgccggtgtagccgaaggaatgcaaatgtccgtgaacggcaagggaaatgccgcgccccgaggaggcgtgaatggcgacttgatagtcgtgatcgccgaggaaccggatccgaatctgatccgcaatggcaacgatctgatatacaatctgcttatatccgttccgttggctataaaaggaggtagtgtggaagtgccgacgatagacggacgagccaagatccgcatcgaggcggggacacaacccggcaagatgctgcgtttgcgcaataaggggttgcccagcgtaaacggctatggcatgggagaccaactggtgaatgtcaatgtctatatccccgaatcgatcgatgccaaagatgagcaggctatcgcagcgatggaaaactcggacagcttcaaacctaccgatgctgctcgtaaggatatagacaagaaatacagagagatgctggat

SEQ ID NO: 153 - DNA, 879 bp, Porphyromonas gingivalis
atgaaaaaactgattttagcgactttgggacttatggccattgccatgctctcatgttcaagcaacaacaaggatttggagaacaaaggggaggctactcttttggtaacgtttggtagctcctataaagctccacgcgaaacctatgcgaagattgagaagacttttgccgcagcttatcccgatcaaaggataagctggacatacacgtcttctattatccgaaagaaactggctcagcagggtatttatatcgatgctccggatgaggctttggagaaattggctcgtctgggttataagaagatcaatgtacagagtcttcatgtgattcccggccgagaatatgatgagatgatcgactttgtcaataagtttaaggcagcacatagtgatattactgtgaaggtaggggctccgcttttcgataccgatgaagatatgcgcgaggtggcagagatcttgcacaagcgttttcagcaaacgatagagaaaggtgaagctattgtattcatgggacacggcaccgagcatgctgccaatgacaggtatgcccgtatcaataagatcatgaagaactatagcaagttcatgatcgtcggaaccgtcgagtccgatccctctatcaatgatgttattgccgaactgaaagaaaccggtgccacggccgtaacaatgatgccgctgatgagtgtggcaggcgaccatgctacgaatgatatggccggagatgaggacgatagctggaagacgttgctgaccaatgccggctacacagtttctatagacaagctggacaatggcaatttctcagctcttggagatatagaagagatccggaatatctggctcaagcatatgaaagccacctctgctcgc

SEQ ID NO: 154 - DNA, 1068 bp, Porphyromonas gingivalis
atgacatccgtcagccacttacgtacaatttctgtcgcaggtatcctggctgcgctgggaggggctgtactcattctcttcggggttaatctcttcctcggctcggtggctattccgatgagcgagatcttccgacatcttttttcagatcgtcccgaaggaggagaagcactcgtgcactacaatatcctatggaaatcccgcctgcccgaagccctcacggctgcttttgccggcgcaggtttatccgttagtggcttgcagatgcagaccgtctttcgcaatcctttggccggtccgtccgttctcggcatcagctccggtgccagtttgggtgttgctttggtcgttctgctgagcggctcgctgggaggagtggcattgagtagcctgggttatatgggcgaggtggccatgaatatagccgctgccgtaggctcgctggcagtaatggggctgatcgtttttgtcagcaccaaggtgcgcagccacgttacgctgctcattatcggcgttatgatcggatatgtagccactgccgtcatcggggtattcaagtttttcagtatcgaagaagatattcgggcatacgtaatttgggggttgggcagcttttcccgtgccacggattcgcaactgagtttctttgccattctgatgttgatctttattccggccggtatgctccttgtcaagcagttgaatctcttattgctgggagaaagctacgcacgtaatctgggactgaatactcgtcgggcacggctgctcgtgatctcttccgccggtttgctcatcgctaccgtcacggcctattgcggtcccatcggctttttggggatggctgtgccacacttggcacgggttatctttcacacatcggatcatcggatcctgatgcctgctacctgtttgattggaagtgctctggctcttttctgcaatatcattgctcgtatgccggggtttgagggggctttgcccgtcaattccgtaacggctttggtgggagcacctattatcgtcaccgttttgttccggcgcagacgcttcaaggaagaaaccgac

SEQ ID NO: 155 - DNA, 2271 bp, Porphyromonas gingivalis
atgcggacaaaaactatcttttttgcgattatctcttttattgctctattgtcgtcttctctgtcggctcagagcaaagccgttttaaccggtagtgtgtcggatgccgaaaccggagagcctcttgccggtgctcgaatcgaagtcaaacacaccaacatagtagccggtgccgatgccggcggacatttcgagatcaagaacctgccggcagggcagcatactattatatgttcgttgggggggtatggacagaaagaggaggtggttgccatcgaagccggacagaccaaaacgatctcttttgcattgcgactgcgaacgaacaacttggaggaagtcgtcgttaccggtaccggtacacgttaccgcttggtcgatgctcctgtggcaacggaagtccttaccgctaaggacatagcctctttctcggctcctacttccgaggccttattgcaggggctgagtccgtcttttgacttcggccccaatctgatgggctctttcatgcagctgaacggccttagcagtaagtatatcctcatccttatcgatggtaagcgtgtgtacggcgatgtaggcggtcaggccgatttgagtcgtatttctcctgatcagatcgaacggatcgaactggtgaaaggtgcttcgagttcgctctacggatccgatgccatcgccggggtaatcaatgtgatcacaaaaaagaatacgaatcgactgagtgcatatacgtcacatcgcatatcgaagtacaacgatcggcaaaccaatacttcgctcgatataaacatcggtaagttcagtagcaataccaactatttcttctaccatacggatggctggcagaatagtccgttcgaaataaaaaagaaaaaaggatccggcgaaccggtcttggaggaaacgtataagaaaacttttcgtgcacaggaaaatcagggtgtaagccaatcgctttcctattatgcaactaacaatcttagcttcagcggaaatgtgcagtacaataaacgtcagatcttcactccgactttttccgaaaagaaggcctatgacatggattatcgtgctttgacggcttcactcggtacgaactatcttttccccaatggtctgcatacgctttctttcgatgccgtctacgatcgcttccgtttcggatatttgtatcatgacaaggacagcagtgagagcctgatcaacaaccaaggtcagaccgagcaacccacattctttccgggtcagctacgcaataaaaacgatcagatccgatacacggcagaggctcgcggtgtatttacactgccttatgcgcagaaactgaccggcggtttggagtatttccgtgaggaattgatctctccctataatttgattaccgacaaggcagatgcttccacgctctctgcttatgtacaagatgaatggaaaccgctcgattggttcaatatgacagccggtttccgtctggtacaccatcaggagttcggtacacgaatgacgcctaaggtatccatactcgccaagtatgggccgctgaacttccgcgctacgtatgctaacggctataagactcccacgctgaaagagctttttgcacggaacgaactcaccactatgggttcgcacaatctctatctcggcaatgcggatcttaagccacagatgtcggattattatgctttgggcttggagtacaatcaaggccctatctcgttcagtgcaacggtttatgacaatgaacttcgcaatctgatctcctttatggatataccgacctcacccgagcacgaagctcagggaatcaagaaaaccaagcagtatgccaacataggaaaagctcgcagccgcggccttgatgtcctatgtgatgcctctatcggttggggtatcaagttaggagccggatacagcctcgtggaagctaagaatctccagacggatgagtggctggaaggagctgcacgtcatcgtgccaatgtgcacgccgattgggttcactactggggtcagtatagacttggcgtgagccttttcggccgtattcagagcgagcgttactacaaagacggcaatgctccggactataccttgtggcgactcgccacatcgcatcgtttcgctcatttccgccacatcatcctggatggaacgctcggtatagacaacctgtttgactacgtggatgatcgtcctatgggtgtcaattatgctaccgtaacgccgggacgtactttctttgctcaaatagcgattcgattcaacaac

SEQ ID NO: 156 - DNA, 993 bp, Porphyromonas gingivalis
atgacggacaacaaacaacgtaatatcgtattcccggcgtttctcctcttgctgggagtcatcgcagtggtgacgatcgttggttttttcatgctcagaccggccgaggagattatccaaggacagatagaagtgaccgaataccgagtgtccagcaaagtgcccgggcgcatcaaggaacttagggtatccgagggacagcaggtgcaggccggcgataccctcgctgtcatcgaagcccccgacgtagcggctaagatggagcaggcaaaggctgccgaagcagctgcacaggctcagaacgccaaggctctcaaaggagcacgcagcgaacagatacaggcagcctatgagatgtggcagaaagctcaggccggcgtagccatagcgaccaagacacaccagcgcgtgcagaacctctatgaccagggagtggtaccggctcagaagttggacgaagccactgcccagcgcgatgcggccatcgctacgcaaaaagcggccgaagcccagtacaatatggctcgcaacggtgccgaacgcgaagacaagctggcagcttctgccctcgtcgatagagcgagaggagccgtcgccgaggtggagtcgtacatcaacgaaacctacctcatcgccccacgggcaggcgaagtgtcggagatattccccaaagccggcgaactcgtaggtaccggcgcacctatcatgaatatcgccgagatgggcgatatgtgggccagctttgccgttcgtgaggatttcctcagcagcatgaccatgggagccgttctggagactgtggtgccggctctgaatgaagaaaaagtacgcttcaagatcacattcatcaagaacatgggtacctatgctgcctggaaagcgaccaagacaacagggcagtacgacctgaagaccttcgaggtaaaggccacccttgcggataaagacaaggcacaaaagctacgcccgggtatgtccgtgatcatacgcaag

SEQ ID NO: 157 - DNA, 801 bp, Porphyromonas gingivalis
atgcgtattgtcagtaattttttgttcgtctctttttcggttttgctttttgcatcatgccgttcccagcgagaaaaggtcgtttacctgcaagatatccaaacttttaatcgggagattatcgctaaaccatatgacgtaaaaattgagaaggacgatgtgctgaacatccttgtcagcagtagagacccggagctttcaacgccctacaaccaagtgttgaccactcgtgcactggcccgcaacggctatggaacgaactcgaacgaaggcttcctggtcgattcgaaagggtacatcaattatcctattttaggccagatctatgtagagggccttactcgtaccgaactggagaaggagatacagaagaggattatttccagtggatttatcaaggatcctacggtaacggtgcagcttcaaaatttcaaggtgtcggttttgggagaggtgaatcatccgggttcgatgtcggtaaaaggagagcgaataactcttttggaagcgatcggaatggccggagacctgacaatctatggtcgccgcgatcgggtttttgtgattagagaaaccgatgggcatcgcgaggttttccagacggatctcagaaaggccgacttgctcgcaagccccgtgtactatctgcatcagaacgacgtcatctatgtggagccgaacgacaagaaaacacagatgagcgagatcaaccagaataataacgtaaacgtatggctgagtgttacctccactttggtatccatttccacgctgacgattacgataatagataagaccaaa

SEQ ID NO: 158 - DNA, 1707 bp, Porphyromonas gingivalis
atgaaaaagaccaatctgtttttatctctgctggtgatctttatcaccggtagttttatgactgcctgtgcacagaagtccaagacgaacaaactcaccgaagaagatcggagccgcaatgagtatgtacagtcgatggatgtgcttagcaatattatcggtaacgtcaggctgtatttcgtcgataccataagtatcaaacatatgactcggcgtggtatagatgcgatgttgggcgggcttgacccctataccgaatacattccttacgaggaaatggatgaactgaaattgatgactacgggagagtatgccggagtcggagctatcatatcgcagcgcccggatagtgctgtgattatccagagacctatggaaggtatgcccgcagacgaagcaggattgatagcaggcgaccgcatcctgactatcgatgggaaagacttccgcaaatccaccacaccgaaagtaagccaagcactgaaagggatagccggtactgttgcaaaggtgacagtaatgcgctatggcgaaaccaaacctcgtactttttccgtgaaacgtcaaaaagtgattatgaattccgtcacttacagcggaatgctcgatggctcgataggatatatccgcttgaacaactttacggacaaaagtgcagaagaggtgcgcacggccttgttggatcttcgtgacaaacaaggagcgaaaggtctcattttggatttaagaggcaatggtggcggactgatgcaggctgctatcgagatagtcaatctgttcgtccctaagggcaaagaggtggtaacgaccaaaggtcgcattgcagagtcggcgtccgtatttcgcacattgactgaaccgatcgacacgaaactcccgatagtagtcctgatcgatggacaatcggcatcttcctcggagattgtagccggagcactgcaggatatggacagggctgtactgatgggacaaaagagctatggcaaagggcttgtacaaacgactcgtcagctaccatacaacggcgtgatcaaattgactacggccaagtactacatcccaagcggacgttgtattcagcgtttggactacagccgcaccaatcggacaggtatggcaacggccattcctgacagtctgcacaaaatcttttacactgctgccggaagacgtgtagaagatgcaggaggaatcctgcctgacatcgaggtcaaacaagatacagctgcgacattactttattatatggccatcaataatgacgttttcgatttcgtcacaggttatgtgctcaagcataaaacgattgccaagccggaggatttttccataacgaacgaggactatgcagctttctgcaagatgatggaagaaaagaaatttgactatgatcgccagagtggcaagatgcttgacaaactggaggaactggctaagatagaaggctacctgccggaagccaactcggagcttaaagcactacgcgaaaagctaaaacccaacctgtcgcgtgatctgctacgattcaaaaaggagataacaaactatctcaacaatgagattgtcactcgctattattatgagcgaggcagtatccgccagagtttgccggaagataaggtagtcaaagaagctattaagctgctgaaggaccatccggaacaaattcgacagatccttgcagctccgaaagcagagaataaaggg

SEQ ID NO: 159 - DNA, 2943 bp, Porphyromonas gingivalis
atgcaaaacaaaggatttgtgattgttatcacatcggctctggccatcatctgtgcgttttacctgtcattctctttcgttacgaaccgttacgaaaagaaggctaaggcgatgggcgatgttgccggaatggcctatcttgattccatgtcgaatgagaaggtctggttcggctacacgctgaaagaagctcaagcccagcaaattggtcttggccttgacttaaaggggggtatgaacgttatcttgaaacttaacgcaagcgatctgcttcgtaacctctctaacaaaagtttggatcccaacttcaacaaagctctggagaatgctgccaagagcacggagcaatccgacttcatcgatattttcgtgaaggaatatcgcaagctcgatcccaacggtcgcttggccgttatcttcggttcgggtgaccttcgcgaccagattaccgcaaagtctacggatgcagacgtagtgcgtctgctcaaagaaaaatataatagtgctgtagaagcttcgttcaatgtgctccgtgctcgtatcgatgctttcggtgtggttgcacctaatttgcagcgattggaagggcaagggcgtatccttgtcgaactccccggagtgaaagaccctgagcgtgttcgtacccttttgcaacgcagtgccaacctacagttctggcgtacatacaaattcgaagaggtcagcggagacttgatcgctgccaatgatcgtctgagcgaattggctatgaacaacacggatgctaccccggaaacagagcctgcaactactgactctgtagctgcaacagccgattctgctgctgtacaagctgtagctgattctgctactgtagcacaaaaagaggccaaggatgctactcgtaaagacgcactcttctctctgcttactcccgtgaatcgtggcggtgcagtagtgggtgtggctcgtcgtgctaatatggctcagatatctgaaatgctccagcaagctcacgatctgaaggttacacgtgaagatgtgcttttcctctggggtgctaaagcaatcgaagaccccgaaaccaaaaaggagaccgacctctacgaactctatgctattcgtaccaatcgtacgggagatcctgatttgggaggtgatgtagtgacttccgccaagagtgatatccaaaatgacttcggtcgttccgaaccgatcgtttcgatgacgatgaatgaagaaggtgctcgtaaatgggcgcgtatcacaaaggataacgtgggacgggcaatcgctatcgttttggatggtgtggtttattctgctccgaacgtgaatgatgagatcacgggcggtcgctctcagatctccgggcacttcaccgtggaggaggccggtgaccttgccaacgtactcaactccggtaaaatggatgctacggtaagcatcgaacaggaaaacgtgattggtcctacgctgggtgccgagtccattaaagccggattcttgtcgttcctgctcgctttggttatcctgatgtgttacatgtgtctggcttacggtttcttgccgggtcttatcgcaaacggcgcattgattgtaaacagcttcttcacattgggcgtattggcttctttccatgccgtgctgaccctctcgggtatcgcaggtttggtgctgacgctgggtatggctgtggatgccaacgtacttatcttcgagcgtatcaaagaagagcttcgtgccggtaagactccgattcgtgccgttacggatggttatggcaacgctttctctgccatcttcgactcgaacgttacgactattattaccggtatcatcctattcctctacgggacggggccgattcgcggttttgccactacgttgattatcggtcttatcgcttctttcattacggctgtcttcttgactcgtatcgtcttcgagaaactggcgaaaaaaggtcgtttggataagattacattcactacgagcattactcgcaatctccttgtcaatccctcatacaacatcttgggtaagcgcaagaccggctttatcattccggtgattatcatcgttttgggacttatagcttcatttacaatcggtctcaataggggtattgaattctccggaggacgtaactacgtagttaaattcgaccagcctgtatcttccgaagccgttcgttcggccttgtcttctcccctgcaggaaaaggtattggttacctccatcggtactgaagggacagaggtgcgtatatctacgaactataagatccaggaggaaagcgaagaaactgaagcagagattactgacaaattgtatcagagcctgaaaggtttctacacccagcagcctactgctgatcagttcttggacaatatcattagctctcagaaagtaagtcccagtatgtcgagtgacatcacgagaggtgctatttgggctgtgctgttatcgatgatcttcatggccatttatattctgattcgcttccgtgacatttctttctctgccggggtattcgtatctgtggccgctactacattctgcattattgctctgtatgcgttgctgtggaagattctgcccttcaccatggagatcgatcagaacttcatcgctgctattctggctatcatcggttactcgctcaatgacaccgtggttgtatttgaccgtatccgagagacgatgaaattgtaccccaacagagatcgctatcaggtgatcaacgatgcccttaattcaacattgggtcgaacattaaatacgtctttgactacgtttatcgttatgttggtaatcttcatctttggaggtgctacgatgcgtagtttcacgttctcgatcctgctcggtatcgttatcggtacatactctacgctctttgttgctacaccccttgcctacgagatccaaaagcgcaagctcaacaaagcagctaagaaa

SEQ ID NO: 160 - DNA, 3051 bp, Porphyromonas gingivalis
atgaaaagaatgacgctattcttcctttgcttgctgacgagcattgggtgggctatggcccagaatagaaccgtgaagggtacagttatctcctccgaggataatgagcccctgatcggcgcgaatgtcgtggttgtcggaaacaccactatcggtgctgcaaccgacttggatggcaacttcacgcttagcgtgcctgccaatgccaaaatgttgagagtgtcctattccggtatgactaccaaagaggtcgccatcgctaatgtgatgaagatcgtactggatccggactctaaggttctggagcaggtagttgtattgggttacggtacgggacagaaactcagcactgtttccggttctgtggccaaagtgtccagcgaaaagctcgcggaaaagcccgttgccaatatcatggatgccctccaaggtcaggtagccggtatgcaggttatgactacatccggtgaccctactgccgtcgcttctgtggagatccatggtacagggtcgttgggggcaagctctgcaccattgtatatcgtggatggtatgcaaacttctttggatgttgtggctacgatgaatccgaatgattttgaatctatgtccgttttgaaagatgcttctgcaacatctatttatggagctcgtgctgcaaacggagtcgttttcattcaaacgaagaaaggtaaaatgagcgagagaggtcgtattacctttaatgccagttacgggatttctcaaatcctgaatactaagccccttgataatatgatgactggagatgaattgctggattttcaggtgaaggcaggtttttgggggaacaatcaaaccgttcagaaggttaaagatatgatccttgccggagctgaagatttgtatggcaattatgattctttgaaagatgagtatggtaagacattgttcccagtggattttaatcatgatgcagactggctcaaggctttgtttaaaacagcacccaccagtcaaggtgatatttctttctccggagggtctcagggaacttcatattatgcctctataggctacttcgatcaggaaggtatggctcgtgaaccggcaaattttaagcgctatagtggccggctcaacttcgaaagtcgtatcaatgaatggctgaaagttggtgcaaatttgtctggtgcgatagcgaatagacgatctgccgactattttggaaagtattatatggggtcaggtactttcggtgtgttaacgatgcctcgttattataacccttttgatgtgaatggggatttagcagatgtctattacatgtatggagctaccagaccttctatgacagaaccgtacttcgcaaaaatgagaccgttcagttccgaatcacatcaggccaatgtaaatggtttcgcccagattactccgatcaaaggccttactttaaaggcacaggctggtgttgatattactaatactcgcacttcttctaagagaatgcccaataatccgtatgattctactcctcttggggaaagaagagaaagagcttatcgagatgttagcaagtcttttacaaatacggctgaatataagttttcaattgatgaaaaacatgatcttacagcattgatggggcatgaatatattgaatatgaaggggatgttattggggcatcttctaaaggatttgaaagtgataagttgatgttactgagccagggaaaaaccggaaatagtttgtctttgcctgaacacagagtcgctgaatatgcctatttgtctttctttagtcgttttaattacggttttgacaaatggatgtatatagatttctctgttcgtaatgaccaatcctctcgattcggatccaataatagaagcgcgtggttctattctgtcggtggaatgtttgacatatataataaattcattcaagaaagtaattggctcagtgatcttcgactgaaaatgagttatggtacaacgggtaactcggagattggtaattacaaccaccaagcactcgttactgtgaacaattatactgaagatgctatggggcttagcatttctacagcaggcaatcccgacctctcgtgggaaaagcagtctcagttcaacttcggtttggctgcaggggctttcaataatcgcttatctgcagaggtagatttctatgtccgcactacgaatgatatgttgattgatgtcccgatgccttatatcagtggtttcttctcacagtatcagaatgtaggctctatgaaaaatacgggtgtagacctttctcttaaggggacgatctaccaaaataaggactggaatgtatatgcttctgcgaatttcaactacaatagacaggaaataacaaagcttttcttcggtctcaataagtacatgttgcctaataccggtactatatgggaaattgggtaccccaattcgttctatatggctgaatatgctggaatcgacaaaaaaaccggtaagcagttgtggtatgttcctggtcaagtcgatgcggatggtaataaagttacaacaagccagtactcagctgacttggagacacgaattgataagtctgttactcctcctattacaggtggtttctccttaggtgcttcttggaaaggactttctttagatgctgattttgcctacatcgttggtaaatggatgatcaataatgaccgttactttacagagaatgcaggtggattgatgcaattaaataaagataaaatgctattgaatgcctggacagaggataataaagaaacagatgttccaaaattgggacagtctcctcagtttgatacgcatttgttggagaatgcttctttcctgcgtttgaagaatctcaaactcacctatgtactccccaatagtctttttgctgggcagaatgtgattggtggagctcgtgtctatttgatggcgcgcaatctgttaactgttacgaagtataaaggctttgaccctgaagcaggggggaatgtgggaaaaaatcaatatcctaattctaagcagtacgttgcgggtattcagttgtctttc

SEQ ID NO: 161 - DNA, 3042 bp, Porphyromonas gingivalis
atgacgctattcttcctttgcttgctgacgagcattgggtgggctatggcccagaatagaaccgtgaagggtacagttatctcctccgaggataatgagcccctgatcggcgcgaatgtcgtggttgtcggaaacaccactatcggtgctgcaaccgacttggatggcaacttcacgcttagcgtgcctgccaatgccaaaatgttgagagtgtcctattccggtatgactaccaaagaggtcgccatcgctaatgtgatgaagatcgtactggatccggactctaaggttctggagcaggtagttgtattgggttacggtacgggacagaaactcagcactgtttccggttctgtggccaaagtgtccagcgaaaagctcgcggaaaagcccgttgccaatatcatggatgccctccaaggtcaggtagccggtatgcaggttatgactacatccggtgaccctactgccgtcgcttctgtggagatccatggtacagggtcgttgggggcaagctctgcaccattgtatatcgtggatggtatgcaaacttctttggatgttgtggctacgatgaatccgaatgattttgaatctatgtccgttttgaaagatgcttctgcaacatctatttatggagctcgtgctgcaaacggagtcgttttcattcaaacgaagaaaggtaaaatgagcgagagaggtcgtattacctttaatgccagttacgggatttctcaaatcctgaatactaagccccttgataatatgatgactggagatgaattgctggattttcaggtgaaggcaggtttttgggggaacaatcaaaccgttcagaaggttaaagatatgatccttgccggagctgaagatttgtatggcaattatgattctttgaaagatgagtatggtaagacattgttcccagtggattttaatcatgatgcagactggctcaaggctttgtttaaaacagcacccaccagtcaaggtgatatttctttctccggagggtctcagggaacttcatattatgcctctataggctacttcgatcaggaaggtatggctcgtgaaccggcaaattttaagcgctatagtggccggctcaacttcgaaagtcgtatcaatgaatggctgaaagttggtgcaaatttgtctggtgcgatagcgaatagacgatctgccgactattttggaaagtattatatggggtcaggtactttcggtgtgttaacgatgcctcgttattataacccttttgatgtgaatggggatttagcagatgtctattacatgtatggagctaccagaccttctatgacagaaccgtacttcgcaaaaatgagaccgttcagttccgaatcacatcaggccaatgtaaatggtttcgcccagattactccgatcaaaggccttactttaaaggcacaggctggtgttgatattactaatactcgcacttcttctaagagaatgcccaataatccgtatgattctactcctcttggggaaagaagagaaagagcttatcgagatgttagcaagtcttttacaaatacggctgaatataagttttcaattgatgaaaaacatgatcttacagcattgatggggcatgaatatattgaatatgaaggggatgttattggggcatcttctaaaggatttgaaagtgataagttgatgttactgagccagggaaaaaccggaaatagtttgtctttgcctgaacacagagtcgctgaatatgcctatttgtctttctttagtcgttttaattacggttttgacaaatggatgtatatagatttctctgttcgtaatgaccaatcctctcgattcggatccaataatagaagcgcgtggttctattctgtcggtggaatgtttgacatatataataaattcattcaagaaagtaattggctcagtgatcttcgactgaaaatgagttatggtacaacgggtaactcggagattggtaattacaaccaccaagcactcgttactgtgaacaattatactgaagatgctatggggcttagcatttctacagcaggcaatcccgacctctcgtgggaaaagcagtctcagttcaacttcggtttggctgcaggggctttcaataatcgcttatctgcagaggtagatttctatgtccgcactacgaatgatatgttgattgatgtcccgatgccttatatcagtggtttcttctcacagtatcagaatgtaggctctatgaaaaatacgggtgtagacctttctcttaaggggacgatctaccaaaataaggactggaatgtatatgcttctgcgaatttcaactacaatagacaggaaataacaaagcttttcttcggtctcaataagtacatgttgcctaataccggtactatatgggaaattgggtaccccaattcgttctatatggctgaatatgctggaatcgacaaaaaaaccggtaagcagttgtggtatgttcctggtcaagtcgatgcggatggtaataaagttacaacaagccagtactcagctgacttggagacacgaattgataagtctgttactcctcctattacaggtggtttctccttaggtgcttcttggaaaggactttctttagatgctgattttgcctacatcgttggtaaatggatgatcaataatgaccgttactttacagagaatgcaggtggattgatgcaattaaataaagataaaatgctattgaatgcctggacagaggataataaagaaacagatgttccaaaattgggacagtctcctcagtttgatacgcatttgttggagaatgcttctttcctgcgtttgaagaatctcaaactcacctatgtactccccaatagtctttttgctgggcagaatgtgattggtggagctcgtgtctatttgatggcgcgcaatctgttaactgttacgaagtataaaggctttgaccctgaagcaggggggaatgtgggaaaaaatcaatatcctaattctaagcagtacgttgcgggtattcagttgtctttc

SEQ ID NO: 162 - DNA, 2463 bp, Porphyromonas gingivalis
atgaagaaaaagaattttttgcttcttggcattttcgttgctttgctgactttcatcggcagcatgcaggcacaacaggccaaagattatttcaactttgacgaacggggcgaggcctacttctcattcaaagtgcctgatagggccgttctacaagagctggctctgatcatgtccatcgacgagtttgaccccgtaaccaatgaagccattgcctatgccagcgaagaggagttcgaggcattcctgcgctatgggctcaagcctacattcttgactcctccatccatgcagcgcgctgtcgagatgttcgactaccgctcaggagaaaaatacgaatggaatgcttaccccacctatgaagcctatatcagcatgatggaagagttccaaacaaagtatccatcactttgtactacttccgtcattggcaagtccgtaaaggatcgtaaactgatgatttgcaagctgacgtcctctgccaatacagggaaaaagcctcgcgtgctctatacttctacgatgcacggagacgaaacgaccggatatgtggtactgctccgactcatagaccatctgctgtcgaactacgaatccgatccgaggattaagaacattctggataaaacggaagtatggatctgccctttgaccaatccggacggagcatacagagccggaaaccacaccgtacaaggagctactcgctacaatgccaacaatgtcgatttgaaccgtaacttcaaggatgatgtagccggtgatcaccccgatggaaaaccttggcagccggaggcaactgcattcatggatttggaaggaaacacctctttcgtgctcggtgccaatatacatggaggaacagaggtggtgaactatccatgggataataaaaaagaaagacatgcagacgatgagtggtacaaactgatcagtcgcaactacgcagccgcttgtcagagtatttccgccagctacatgacctccgaaaccaattcgggaatcatcaacggttcagactggtatgtaattcgcggaagtcgtcaggacaatgcaaattatttccatcgtctgcgagaaattacccttgaaatcagcaacacgaagttggtgccggcctctcaacttccaaagtattggaatctgaacaaagaatctctgcttgctctgatcgaagaatccttatacggcatccatggtacagtgacttccgctgcgaacggacagcctctcaaatgccagatcttgatagaaaaccatgacaagcgcaactccgatgtttactccgatgctaccacaggctactacgtacgtcctatcaaagccggcacttatacggtgaaatacaaagccgagggttatcctgaggcaactcgtaccattacgatcaaggacaaagaaaccgtcatcatggacattgcattgggcaactcggttcctctgcctgtacccgatttcacagcttctcctatgaccatctcagtaggcgaaagcgtccaattccaagatcaaacgacaaataaccccacgaattgggagtggacgttcgaaggcggacagcctgccatgagtacagagcagaatccgctcgtatcctatagtcatcccggtcagtacgacgttacgctcaaagtgtggaatgcaagtggttccaacacgattacgaaagaaaaattcatcactgtcaatgccgttatgcctgtagctgaattcgtcggtaccccgacggaaatagaagagggccagacggtatctttccaaaaccaatccaccaatgccaccaactacgtatggatattcgatggcggcactcccgctaccagtgaagacgaaaacccgactgtgctttacagcaaagccggccaatacgatgtcacgctcaaggcgatcagtgcttccggtgaaacggtgaagacgaaagaaaaatacatcactgtcaagaaagctccggtccctgctccggtagccgacttcgaaggaacacctcgaaaagtaaagaaaggcgagacagttactttcaaagacttgtctacgaacaatccgacttcatggctttgggtgttcgaaggcggctctcctgccaccagcacggagcaaaacccggtggtcacctacaatgaaacaggcaagtacgatgtccagctgactgccaccaacgagggcggaagcaatgtgaagaaagcagaagactacattgaggttatcctcgatgacagtgtcgaggacatagtggcacagacgggtatcgtcattcgtccgcaaaacggaacgaagcagatcctcatagaagccaacgctgctatcaaagcgatcgttctctatgacatcaatggacgggtcgtactcaaaactactccgaatcagctccgctcgaccgtagatctttccatcctgcccgaaggaatctacaccatcaatatcaaaacggaaaaatccgctcgcacggaaaagatccatatcggg

SEQ ID NO: 163 - DNA, 228 bp, Porphyromonas gingivalis
atgcgactgatcaaggcttttctcgtgcaactcttactgctccccattttcttctacaagcggtttatatcgccgcttacaccgccttcatgccggtttaccccctcatgttcgtcctatgccatcgaagccttacgtaaatatggcccgggcaaaggactattgctgagcatcaagcgtattctccgctgtcacccgtggggtggaagtggctatgaccccgttccg

SEQ ID NO: 164 - DNA, 2577 bp, Porphyromonas gingivalis
atggcatacgactttacacaaacattccgcaacagcctggagtacagctatcaggaagcaacccgtctcggcgtcgtagccgtgacgcaagatatgctcgtactcggtatcattcgcgacggagacaatggcgcgatcgacatcatgcggcactatgggatcaacttgtacgaactcaaacggttgatcgagttggaagccatcgccgagagtttgcctgcttcgcctgagggatcgcccatcttcaccccttcggctcgggaggctatcgatgatgccacagacatctgtgccgacatggaggacgaggccgtcagcccggtccatctgttgctgagtatcctcaactcgacacaggagagcttagtacaaaagatatttatgaaacaaggtataaaatacgacaccatcctgtcggattacttcggacagcgcaacccctccgaagggaagtctccctccgaaatggagatcctcgacgggtaccaagacaacgacttcgacgacgaagaggacgaatcctctccgccttccgggaatagcgggacaggcggaggctccggcgacgcccccgaacagaataccggcggaggcgatactaccaccacgacacggagtggaggcgacacgcctgcactggacaccttcggcaccgacatcactgccatggcggcagcaggcaagctcgacccggtagtgggtcgggagcaggagatcgaaagggtgatacagatactcagccggcgcaaaaagaacaatccggtgctcatcggcgaacccggtgtaggcaagagtgccatcgtggaaggactggccgaacgcatcgtgaacaggaaggtgagccgtattcttttcgacaagcggatcatcagcctcgatttggctcagatggtagccggcaccaaatatcgcggacagttcgaagagcggttgaaagccgtgctcgatgagctgaagaagaatccgcagatcatcctcttcatcgacgagatacataccatcgtgggagcaggctctgcagccggatcgatggatacggccaatatgctcaaacccgctcttgcccgtggacaggtacagtgcatcggagccactacgctggatgagtatcgtaagaacatagaaaaggacggagcactcgaacgccgcttccagaaggtgccgatagccccctcgactgcagaagaaacgctgaccatcctgcaaaacatcaaagagaaatacgaggactatcacggtgtacgctatacggacgaagcgatcaaagcggcagtggaactgaccgatcgctatgtatccgatcgtttcttcccagataaggcgatagatgccatggacgaggccggcgcgagcgtccatatcaccaatgtggtggctccgaaagaaatcgagatactggaggccgaattggcatcggtgcgagagaacaagctctcggccgtaaaggctcagaactacgaactggctgcctccttccgcgatcaggagcggcgcactcagcagcagatagcggaagagaagaaaaaatgggaagagcagatgtccaagcaccgcgagacggtggacgagaatgtagtggcgcatgtagtggcgttgatgacaggcgttccggctgagcggctgagcacgggcgaaggcgaacgtctgcgcacgatggcagatgatctcaagaccaaagtagtaggtcaggacacagccatcgaaaagatggtgcatgccatccagcgcaatcgtctgggacttcgcaatgaaaagaaaccgatcggttctttccttttcctcggccccacgggggtaggcaagacctatttggccaagaagctcgccgaatacctgttcgaggatgagaatgccatgatcagggtggatatgagcgagtatatggagaagttctccgtttcgcgtctcgtgggtgcccctccgggatatgtgggctatgaagaaggcggccaactgacggagcgcgtaagacgcaaaccctattccgtggttctcttggatgagatcgaaaaggcgcatgccgatgtcttcaatctgctcttacaggtgatggacgaaggtcagctgaccgacagtctgggacggcgcgtgaatttcaagaacaccgtgatcatcatcacctccaacgtgggtacacgccagctcaaagacttcgggcagggtatcgggttccgttcggaaaaagacgaggaagcgaacaaggagcatagccgttccgtgatccaaaaagctctgaacaagacgttcagccccgaatttctcaaccgtttggacgatatcatcctcttcgaccaactgggcaagacggagattcgccggatggtggacatagagcttaaagccgtcttggcgcgcatccatcgtgccggatacgacctcgtccttaccgatgaagccaaggatgtgatagcgacgaagggatacgacctccaatacggagcacgaccgctcaagcgcacactccagaacgaagtggaggatcgcctcacggatcttatcctctccggacagatcgagaaagggcagacgcttacgctctctgctcgcgatggcgagatcatcgtacaagaacaagca

SEQ ID NO: 165 - DNA, 1251 bp, Porphyromonas gingivalis
atgaattacctgtacatactgattacacttttactctccggctttttttccggtgctgagattgctttcctttcttcggacaaactgcgtcttgagttggacaggaatagaggcgatctcacaggcagagcgttaaacttgctgtatcgacatccggaccaactggtgactactctccttgtgggtaataatatcgttttggtagtctatggtctgctgatggcgggattgctggccgcacctttggcgcaatggattgataacgatgctatgatcgtcgttctccaatctgtcttatccactatcatcatactgtttaccggggaatttctacccaaagccattttcaagaccaatgccaatatgatgatgagggtattcgccctccctatcgtagcgatctattatctgctttatcctctgtctaaactcttcaccggtttatctcgctcttttattcgtctggtggacaagaattatgtgcctacaacagtagggttggggcgcgtagatctcgatcattatttggcagaaaatatgtccggagaaaacgaacagaacgacttgactaccgaagtgaaaatcatccagaatgcgctggatttttccggtattcaggtgcgagactgcatgatcccacgcaatgagatgatagcatgtgagttgcaaacggatattgaagtactcaaaacgacttttatcgataccggtttgtccaagatcattatctacagacagaacatagatgacgtagtaggatatatccattcgagcgaaatgtttcgtgggcaagactggcaaaaacgtatcaatactactgtattcgtacccgaaagcatgtatgccaataaactgatgcgactactcatgcagcgcaagaaaagcattgcgatcgtcatcgatgaacttggaggtacggccggaatggtcacattagaggatttggtagaagagattttcggtgacattgaggacgaacacgacactcgcaagatcatagccaaacagctcggccctcatacctatctggtcagtggtcgtatggaaatagatgatgtgaacgaacgttttgggttgtccttgcctgagtctgacgactaccttaccgtggccggatttatcctgaatagccatcaaaatatcccacaggccaatgaggtcgtggagattgctccttatacttttaccattctcagatcttcttccaccaagatcgaactggtgaaaatgtccatcgacgaccaatcgaac

SEQ ID NO: 166 - DNA, 879 bp, Porphyromonas gingivalis
atgaaacagaactacttcaaaagagtctgctcactgctttggctggttttacccatgcttattatgccattggaagtagcagctcaagagattattccgaacgaagaggtgttggaatcattgactttcgttgcaccggttgaggagacagacgcaatagaggcagaggtagaagctctgcaggagatagtcgctactgaggagattgcggagcaggctgttcgttcttatacctacacggtctatcgtgatggcgtgaagattgcttcaggattgactgagcccacttttctcgatgaagatgttcctgccggcgaacatacctactgcgtagaagtacagtatcagggaggcgtatccgacaaagtatgcgtggacgtagaggtgaaggacttcaaaccggttaccaatctcaccggaactgcttccaatgacgaagtttctttggactgggacggtgtggaagagaaagctgaagagccggcaagtgataaagcagtcagctacaacgtctacaagaatggaaccttgatcggtaatacagctgaaactcattatgtggagaccggtgtagccaatggtacatacatctacgaagtggaagtaaagtatcctgacggtgtatctccgaaggtggctgtaaccgtgaccgtgaccaacagctcattgagcaatgtagatggacaggctccttacacattgcgagtagaaggcaagaagattattgcggaagcccatggtatgatcacgctctacgacatcaacggacgtaccgtggccgtagccccgaatcgattggaatacatggcgcaaaccggtttctatgcagtgcgcttcgatgtggggaataaacaccatgtatcgaaaatacaagtaaga

SEQ ID NO: 167 - DNA, 936 bp, Porphyromonas gingivalis
atgattcctctaagcgagagttttgaatcaggtattccagctatatggaagaccattgacgcagatggcgatggctataattggatgcatttgaccaatttcacgggacagagtggtctctgtgtctcttcggcttcatacataggcggcgtcggagctttgactccggacaattatctgataacacccgaattaaaactacccacagacgcgttggtggaaataatctattgggtatgtactcaagatctcactgctccatcggagcactatgccgtttattcctcttctacaggcaataatgctgctgactttgttaatctcttatatgaagagactttgactgccaaacggatacaatcccccgagttgatccgcggaaatcggacacaaggtgtttggtatcaaagaaaggtggtactccctaacgatactaaatatgttgctttccgccattttaattccacggataatttctggctcaatttggatgaagtatctatcctgtatacccctcttccccgaagagctccgtgtccgcatccgggtggttacacttattctgtattccgtgatggacaaaagatagcgagtggattgtcggcattggcatatatcgatacggatgtaccgtatgggactcaagactattgtgtccaagtcaattatctgcaaggagactcgtataaagtctgcaaaaatatagtggtggcaaattctgcaaacatctatggggcggataagccttttgcgttgaccgtggttggcaagaccattgtagcgagtgctttcaaaggagagatcactctttatgacattcgtggccggctgatagcttccggctgcgatacgcttaggtacaaagcggaaaatggtttttacctcattaaaatacaggtaaacggaactgtctatactgagaaaatccaaatccaa

SEQ ID NO: 168 - DNA, 2529 bp, Porphyromonas gingivalis
atgaaaaaaagttttcttttagccatagtaatgctctttggcattgccatgcagggacattctgctccggttacgaaagagcgagctttgagtctggctcggctggctttgcgacaggtatccttgcgaatgggacaaacagcagtatctgacaagatttccatcgattacgtttatcggcaaggagatgctgagaggggtatcacatcacaagaggaaggctctcctgcatatttttatgtagctaatcgtggaaataatgagggctatgctcttgtagcagcagatgacagaataccgacaattttagcctattcacccattggccgtttcgacatggacagtatgccggacaatcttcgcatgtggctacaaatttacgatcaggaaataggcctgatactttccggaaaagctcagctcaatgaagagatattacgtaccgagggcgtaccggctgaagtacatgctctgatggataacggtcattttgccaacgatcccatgcgatggaatcaaggttacccatggaacaataaggaaccactgcttcctaatggcaatcatgcctataccggctgtgttgctactgctgcagcacaaatcatgcgctaccatagctggccgcttcaaggtgaaggctctttcgattatcatgcaggttcattagttggcaactggtccggcacatttggtgaaatgtacgactggatcaatatgcccggaaatcccgaccttgataatctgactcaatctcaagtggatgcctacgccacactgatgcgtgatgtgagtgcatctgtttcgatgagtttttatgaaaatggaagtggtacgtacagcgtttatgtagtaggagccttgcgaaacaactttcgctacaagcgttcactgcagctacatgtacgcgccttatatacctcacaggagtggcacgatatgatccgcggggaacttgcctccggaaggccggtctattatgcagggaataaccagagcataggacatgctttcgtttgcgatggttatgcttcggatggtactttccatttcaactggggttggggaggtgtttccaacggcttctacaaactaacactcctctcgccgacttcgttgggtatcggaggtgagggaataggttttaccatttatcaagagatcatcaccggtatcgaaccggctaagactcccgctgaagccggtacagatgccttgccgatcttggcactgaaagacatagaagccgagtataaaagtgaatccggattgaacgtagggtattcgatatataatacaggtgaagagcaatcaaatcttgacctcggatacagattgaacaaggctgacggagaagtcatagaggtgaaaacttcatctatcaatatctcttggtacggatacggagagcatcccgagagtttctcattggcacctaatcagttgtcacaaggaatcaacaccatcaccctactttatcgtcgcacaggcaccgaacagtgggagccggtacggcatgcacagggaggatatgtcaatagcattaaagtaaatacgacagacccgaacaatgtcgtagtcacggtagataataacgaaggcaagctcagtatcgtccccaacagctttgtcgcagatctgaattcttatgaacatagtacgattacagtacagttcaatagcgacagccctgatgagatccgtacacccgtagcctttgctctatctacaggagctactgcggacgatgtaatatctttgggctgggtaatggctgaagttccgggcggtagcagcaactatccggtggtttggtctaaagacgttctcactctctcggaaggcgactatacattgtggtatagattttccatcaacaaccaaaaggatgaatggaaaaagatcggaagcgtgtcagtaaaaacaccgacagagtatacgcaccccttattcgaagtgggccataatcaaacttctacctatacgctggatatggcacacaacagagtattgcccgactttacactcaaaaatctcggattgcctttcaatggtgagttggttgttgttttccgccaaacacaatcctcatcggggtctttatgggcagctcaagaaacagtacatatcaagcaaggagaaactttcgtatataaacctgttgtcgaaggccctatacctgatggatcctatcgtgcgaccctccatgcattcgtaaacggacaacaacagttgtacctcaaggggaaaaggaactacacggtgaagatcgtcaatggtacagcggtagaagcaatagaatcgtcagaagagatcagagtattccctaatccggcacgcgattatgtggaaatatcggcaccttgcattccccaagaaacatctatcattcttttcgatctgtcaggcaagattgtcatgaagaatagtttatcagcggggcatggcagaatggatgtcagccgacttcctaatggggcctacatccttaaggtggatggatatacgacgaaaataaatatagtgcac

SEQ ID NO: 169 - DNA, 870 bp, Porphyromonas gingivalis
atgaaaaagctatttctctcgctcacgagtcttgtaatggtcttcgctgttgcaagttgcgatataatcgacaaggatcaaaccctcttgccggctccgaccaatgtgacacccgataatccggatgacaatccttcggagatcgacattacgcagacgcacacagaaaaatatgttttggctgaagaatttaccggccaaaaatgtctcaactgtccgaaaggtcatcgcaaactggcggctctcaaggagcaatacggtaagagattgactgttgtcggtatacatgccggccctggatctctcgtgccacctcttttccgtacagaagccggagacgcatattatagcaagttcgccaataatacccctctccctgcgctgatggtttcgcgcaaaaagttcggctcttcctacgtttatgataagagctacaaaacgtgggacgtgcctattgccgagcagatggagcaaaaggcgaagatcaatatctttgccgtggccgaatacaccgatacccaaaagatcaaggtgactgtaaagggtaaaatactggaggggaatacactcccgaagtccatggttcaggtgtatctgttggaggataagctgatcgctccgcaggtggatggcaatacgacagtcgagaattacgagcacaatcacgtgttgcgtggagccgttaatggtatttggggcgaagaatttgtgaatctcaaagattatttgtatacttacgccgttgaaccgctctcgggtatgtccttcgtagccgagaattattcgattgtggcttttgtatacgatgtgcagacgttcgaagtgtatgacgttgtgcatgtaaagatcaatccgcaatccgatggcaaa

SEQ ID NO: 170 - DNA, 669 bp, Porphyromonas gingivalis
atgaagaaatcaagtgtagtagcctcagttttggccgtggctctcgtgttcgccggttgcggactgaacaatatggcaaaaggcggccttatcggcgccggagtaggaggtgccattggtgccggagtaggtaacgtagccggaaatacggctgtcggtgccatcgtcggtactgcagtcggtggagcagccggtgctctcatcggaaagaagatggacaagcagaaaaaagaactggaggccgcagtacccgatgctacgattcagacagtaaatgacggagaggctattctggttactttcgatagcggtatcctctttgcgacgaactccagcactctgagtcccaactcacgcactgcgctgacgaagtttgctgcaaacatgaacaaaaaccccgacacggatattcgtatcgtaggccatacggacaataccggctccgacaagatcaacgatcctctgtctgagagacgtgcagccagcgtatattctttcctgaattctcagggtgtgagtatgtcgcgcatggcagccgaagggcgtgggagccatgaaccggttgcagacaatagcacagttgccggacgttcggccaaccgccgtgtggaggtttatatcttgccgaatgccaagatgatcgaacaagcacagcaaggtacgctgaag

SEQ ID NO: 171 - DNA, 1011 bp, Porphyromonas gingivalis
atgtcgaaaaaatcgatccttctgctttgctgttcgctgtgcttcatttctgctacgaaggctgtgacccccgtcagaaatgtgcgcaatagccaagtgaacagcaaagcaaagaccgaacgtacaaagccctcggactctgtacggtacattagcaacatgattgcagatcggctggagttccgcaacaagatttcttccgaaaaagaggtaagaaaagccgaatatgaaaatcggctggcgatggaagcactcaattaccctgccatagatttatatggtgaagattcttggagcgagtatgtaaaccctttcgtgggtgcaggaaccgatgtcgaaattccgaactcctatgacattgattgctcttcgttcgtgatgcccgtcgaagataagcaggtcacctctcaatttggctaccgtcggcgtttcggacggatgcactatggtattgatctttcagtgaatcgtggcgatacgatacgagcagcctttgacgggaaagttcgtgtacgcagctatgaagcgcgtggctatggctactacatagtcttgcgccatccgaacggactggagactgtgtacggacacatgagtcgccaattggtagacgagaatcagatcgttcgagcaggacaaccgatcggattaggaggcagcacgggtcgaagcaccggtcctcatcttcacttcgagacccgcttcatgggtattcccatcaatccgagtaccattatagacttcgataacggagtgccgctccgagacatttacacattcaaacgagggagcaattctcgctatgcaaaagcctctaagacttcttctcgctatgcaaaaaaagggaagaaaggcagacaagcttcttctcctatgacctatagaatcaaaaaaggcgatactttggaaacaatagccaaaaggcacggcacttctgttcagaaactctgtgctaccaatggcattggcaagagtaaaattttgactccgggcaaagccttgaggatcaaa

SEQ ID NO: 172 - DNA, 453 bp, Porphyromonas gingivalis
atggcaaaaatcaatttctatgctgaaggcgtcagccttcctcggatcagaagacggatcgtcggtaagtggatagccgaagtatgcagccgatatgggaaagcggtgggagaaatctcctatcttttctgtgatgacgaatatatcctgaaagccaatcaggaatttctcgatcatgactactacaccgacatcatcaccttcgattcctgcgaagcggatacggtgaatggcgacctgcttatcagtctcgataccgtacgctcgaatgcccgtgctcttgatcttcgatacgaagacgaactgcatcgtgtcattatccacggcatactgcatctttgcggattgaaagacaagagcaaaaaggatgaagcccaaatgcgtgcagccgaagagaaagcccttgtcatgctgcgagaaaccatcggatcggagctttccctattgcataca

SEQ ID NO: 173 - DNA, 1173 bp, Porphyromonas gingivalis
  modified_base (723)..(723): n is a, c, g, or t
atgaaggtaaagtacttaatgctcacattggttggagcaattgcactgaacgcaagtgcacaggagaatactgtaccggcaacgggtcagttacccgctaagaatgttgcttttgctcgcaataaagcaggcagcaattggtttgtaacactgcaaggcggtgttgcagcgcagttcctcaatgacaacaacaacaaagacctcatggaccgcttaggagccataggttctctttctgtcggaaagtatcacagccctttctttgcaactcgtttgcaaattaacggaggtcaagcccacactttcctcggaaaaaatggcgaacaagaaatcaacaccaattttggtgcagctcacttcgactttatgtttgatgtggttaactactttgcaccatatcgcgaaaatcgtttcttccatttaattccatgggtaggtgttggctaccaacacaaattcatcggtagcgaatggagcaaagacaatgtggaatcactgacggcgaatgtaggagttatgatggctttcagattaggaaagcgagtagactttgtgatcgaagcacaagcagctcactccaatctcaatctaagtcgcgcatacaatgccaagaaaactcccgtattcgaagatcccgcaggacgttattacaatggattccaggggatggctacagcaggtcttaatttccgcctgggagccgtaggcttcaatgccattganccaatggactacgcacttatcaatgatctgaatggtcagattaaccgtttgcgcagcgaggtcgaagaactctcaaaacgtcctgtatcatgccccgaatgtcctgaagtaactcctgttactaagacagaaaatatactgacggaaaaagctgtactgttccgtttcgacagccacgttgtggacaaagatcaattgatcaacctgtatgacgtagctcagtttgtaaaagaaactaacgagccgattaccgttgttggttatgctgatcctacgggtaatactcaatacaacgagaaattgtctgagcgtcgggctaaagccgttgttgatgttctgacaggtaaatatggtgtgccttccgaattaatctctgtagaatggaagggcgactctacgcaaccgttcagcaagaaagcttggaatcgtgttgtaatcgttcgctccaag

SEQ ID NO: 174 - DNA, 1155 bp, Porphyromonas gingivalis
atgacatacagaattatgaaagctaaatctttattattagcacttgcgggtctcgcatgcacattcagtgcaacagcccaagaagctactacacagaacaaagcagggatgcacaccgcattccaacgtgataaggcctccgatcattggttcattgacattgcaggtggagcaggtatggctctctcgggatggaataatgatgtagactttgtagatcgtctaagtatcgttcctactttcggtatcggtaaatggcatgagccttatttcggtactcgtctccaattcacaggattcgacatctatggattcccgcaagggagcaaggagcgtaaccacaattactttggaaacgcccaccttgacttcatgttcgatctgacgaactatttcggtgtataccgtcccaatcgtgtcttccatatcatcccatgggcaggtataggatttggttataaattccatagcgaaaacgccaatggtgaaaaagtaggaagtaaagatgatatgaccggaacagttaatgtcggtttgatgctgaaattccgcctatcaagagtcgtagacttcaatattgaaggacaagcttttgccggaaagatgaactttatcgggacaaagagaggaaaagcagacttccctgtaatggctacagcaggtctaacgttcaaccttggcaagacagagtggacagaaattgttcctatggactatgctttggtcaatgacctgaacaaccaaatcaactcacttcgcggtcaagtggaagagttgagccgtcgtcctgtttcatgccctgaatgccctgagcctacacagcctacagttactcgtgtagtcgttgacaatgtggtttacttccgtatcaatagtgcaaagattgatcgtaatcaagaaatcaatgtttacaatacagctgaatatgcgaagaccaacaacgcaccgatcaaggtagtaggttacgctgacgaaaaaaccggtactgcggcctataacatgaagctttcagagcgtcgtgcaaaagcggtagccaagatgcttgaaaagtatggtgtttctgcggatcgcattacaattgaatggaagggctcatcagagcaaatctatgaagagaacgcttggaatcgtattgtagtaatgactgcagcggaa

SEQ ID NO: 175 - DNA, 570 bp, Porphyromonas gingivalis
atggaatttttcatgttattcatagcggcggttttcgttaataacgtcgtgctgtcgcagttcctcggtatatgcccattcttaggcgtatcgaagaaggtagacacctcaatcggtatgggtgcagccgtgacattcgtattggcactggctaccttggttaccttcctgattcagaagttcgttttggatcgtttcggattgggctttatgcagaccattgcatttattttggtcattgccgccttggtgcagatggtggagatcatactcaagaaagtatctcctcccctctatcaggcactgggtgtattcttgcccttgattacgacgaactgctgtgtgctcggtgtggctattttggttatccagaaggattataccctgctccagagcttcgtctatgcaatatccacggctatcggtttcaccttggcaatggttactttcgcaggtattcgagagcaactcgatatgaccaatctccccaaagctatgaagggaataccttcggcactcttggctgccggtatattggctatggctttcatgggcttcagcggtatcgcc

SEQ ID NO: 176 - DNA, 558 bp, Porphyromonas gingivalis
atgttattcatagcggcggttttcgttaataacgtcgtgctgtcgcagttcctcggtatatgcccattcttaggcgtatcgaagaaggtagacacctcaatcggtatgggtgcagccgtgacattcgtattggcactggctaccttggttaccttcctgattcagaagttcgttttggatcgtttcggattgggctttatgcagaccattgcatttattttggtcattgccgccttggtgcagatggtggagatcatactcaagaaagtatctcctcccctctatcaggcactgggtgtattcttgcccttgattacgacgaactgctgtgtgctcggtgtggctattttggttatccagaaggattataccctgctccagagcttcgtctatgcaatatccacggctatcggtttcaccttggcaatggttactttcgcaggtattcgagagcaactcgatatgaccaatctccccaaagctatgaagggaataccttcggcactcttggctgccggtatattggctatggctttcatgggcttcagcggtatcgcc

SEQ ID NO: 177 - DNA, 2499 bp, Porphyromonas gingivalis
atgaaacaactaaacattatcagcttcatcattgctttcctattcttaggaacgagcgcatcggctcagcaatcgggcggatccgttacaggtaccgtagtggacaaaagctcaaaagaacctatcgcatacgtacaagtattcgtcaaaggaaccactctcggaacttccacggatgcaaacggaaactactcgatcaagggaatcccttcgggtaatcaaactatcgtagcccgactcatgggttactccacttgcgaagaaaaagtacatatagaaaagggtggttcccgccacgtagacctctatctgaccgaagagattctctctctcgatggggtagtggtatctgccaatagaaacgagactttccgccgtcaagcaccctcgttggtaacggtactgtcgccggaacttttcctcaaaaccaactctaccaacctgagtcagggacttaagttccagcccggtctgcgcgtggaggacaactgtcagaactgcggtttcaaccaagttcgtatcaatggactcgaaggagcctattcgcaaattcttatcgacagccatcccatcttcagttcgcttgccggtgtctatggcttggagcagatgcctgccaatatgatcgaacgtgtagaagtaattcgcggtggaggttcggctctgttcggctctaatgctgtgggaggcgttatcaacgtaattacgaaagaaccgcttcgcaattcggccgagatcagccattctacgatgaccttcgaccacgcgaaagggtgggggagcttccaaaatacgacccagttcaacggttctatgctgacggaagaccgcaaagccggtgtcatggtattcggccaacacaactaccgtcccggacaggatatagacggcgacaactttaccgaactacccaatctgcgcaaccgctcgctcggtttccgctcatactataagaccggtctctacagcaaagcaaccctcgaatatcacagcatgcaggagtaccgtcgtggtggcgacagactggacaatcctcctttcgaagcccagatagcggaatatctccagcactatatcaatggcggaagtttcaaattcgatcagggcttcagcggtggcaaggatttcttcagtctgtatgcttcagcacaagacgttcagcgtcgtagctactacgggggtggcgactataccgaaaatctgctgaacggagcagttcagagtggaagcaccgaatcggacgaatacaacgatgctttcacggctcttacttcctacgggactaccaagggattcgatttgcaaggaggaggtatgtaccgtcataccttcggagaaaactgggactttaccggcggactcgaatatatctacggccaactcgatgacagaagcggctacagaccgagcaaaatagatcagaatacctctacttttagtcagtacgaccagctcgaatataagacggagaagttaagtgcccttatcggagcacgtatcgactatgttctcctcaatcaggatggcaaacgctatatcgatccgctcttcattttcagtcctagagccaacgtacgatacaatcccaataagaatctcagcttccgactctcatacagcgaaggattccgcgctcctcagtatttcgatgaagatctgcacgtagagttggccggtggtactcctatcagccgtgtcctttcccccaatctgaaagaagaacgttcacgaagcatcagtgcttctttcgattattaccacagagccgacgaatggcaattcaatatcatgggagaagccttctccacctttatcagcaatcagttcaaaccatccgataaggtcgaaaccacgagcgatggcaaagaatggatcattcgtaccatctacaacgacaaggatggagtatcgaaggtatatggtgtgaatctggagggaagaatcgcctacaacaaatcgttcgacctccagctcggcggtacatggcagagaagccgctacggaagcatctataccgctgtggaagcggacaaaacaacgggacaagccgagatctctgtgaaagactatgtacgcactccgaatctgtacggctatttcgttgctacggtacgtcctaccgagcacttcgccatcaatctctccggtacattcacgggcaaaatggatgtagtacacgaagcctatgaaggcgatattcccgcagaacacatagctccggacggatcgttcgactttgaaatgaatggtcagcaattcaaaggtttggccgaaggtcatgccaagctcgtcaagactccggccttcgccgatatagacctcaagctgagccacgacttccaccttgcttccactatgaccttggaattgaatgccggaatacagaacatattcaacagctatcagaaagacacggacaagggaccgggtagagcttctacttacgtatacggtcctatgcagcccagaaggattttcgtcggtacaaagatcaatttc

SEQ ID NO: 178 - DNA, 2673 bp, Porphyromonas gingivalis
atgtacaaaaagattattgccgtagcagctctcttctgcgccagcatagggatcctgaaaggacagtcctcggatctgacccctcaggatactatatatagccctgaaatatcctatgccaagcctattcataagaccatagcatctattgagatcgagggaatgaggtctttcgatgactttgtcttgcgcaatctttcaggcttggctgtaggtgatgaagtcctgattcctggagatgccatgtctgctgccgtgaatagaattatgcgtcagggctacttctcaaatgtgcgaatcatcgcggataaatatgtcggcaataaagtctatctgaaaatcattgtcactgaacgtcctcgcatcagtaaggttacttttagcggggtaaagaagtctgagagagaagatcttgaaatgaaaatcggtcttcgcgaggggattcagatgaccagaaataatgaagacaaggtcaggcaaatcgtacagaagtattttagtgagaaaggttatcgcgatgccagcatacggataacgcaggaaccggatctttccaaagatggctttgtcaatgtgcttatctcgattgagaagaaaagcaaaaccaaggtgaatgaaatttatttttccggcaacaaggcccttagcaatcataagctaagaatggcgatgaagaacaccaatgccaaattcagtcttagaaagcatattcgctcatctttcttgaaactttttagtactcataagtttgtggaagagagctaccgtgaagatttggtccgattgatagagaagtatcaggaatatggatatcgtgatgctgaaatactgaccgacagtgtcgtgaaggctcctgacggcaaaagagtggatatttatctcaacatcgaagaggggcagaagtattatattaaggatgtcaactttgtgggcaattcacaatatccatcggagtatttggaacgagtgctcggaataaaatccggagatgtgtacaatcagagacgattggctaagcgtctcaatgaagatgaagatgctgtggggaacctgtactataacaatggctatatttttgcgtgggtcgatcccgtggaaacaaatgtagtgggggattctgtttcgcttgatattcgtatagcggaggggaagcaggccaatatcaataaggtgatcatcaaaggaaatactgtcgtgtacgaagacgtagtacgccgagagctttacacaaagcccggccagctctttagtcgcgaggatatcattaactctattcgtctcatcaatcagcttgggcatttcgatgccgaaaaatctattccccgtccgattcccaatcccgaaacaggaacagtggatatagagtatgatttggtgccgcgtagcagtgaccaattggagctttctgtcggttggagtcagtccggacttctgttccgaggagccattaagttcacgaacttctctgtcggcaacttgctccatccctcgatgtataagaaagggatcattccgcaaggggatgggcaaacactatcactgagtgctcagaccaatggaaagtactatcagcagtatagtgtcacatttatggatccatggtttgggggcaagcggccggatatgttcagcttcagtgcattctattccaagactacggcgattgactccaagttctacaatagcaatgccggcaactactataatgcctactataatagctactacaacaactataatagttattacaacggtatgtcgaactataccggcgacctctatactcaggccagcgatccggatcgttcgcttcagatgttaggtacttcgatcggttacggtaagcgtttgacttggccggacaattggttccagatttatacttctctgaactacacctactatagactgcgaaattggagctacaataccttccaaaatttccatcatggctcggctaatgatctcaacttggagctgcgtctctctcgtacttccatcgataatcctatttataccagaagcggatcggatttcatggtttctgttgctgctactcttccttattctttgtgggacaatcatgactatgccagccagaacctcagcgtaagcgatcgttacagatttatcgagtatcacaagtggaagtttagaggacgagtttttactccattgctcaatcctgctacgcataaatatacaccggtgctcatgagtcgagtggaaggagcagttcttggttcgtataattccaataagaaatctcctttcggtactttctatatgggaggtgatggtatgtccagctattatggtggctacatgaatgagactataggtttgcgtggttataagaacggatctattgccggtaataactacgactatgcatatgcttatatgcggcttacgatggaactacgtttcccgattctgtttgaaaactcattcaatgcgtggctcttagcttttgccgaagcaggcaatgcgtggcgcagtatcgacaattataatccctttaacctgaagcgatcggccggtgtaggattgcgtgtaacgttaccgatggtcggaatgctcggtatcgattggggatatggctttgaccgtccggacaattctctacagcgaggaggaagcaatgtccactttgtgctcggacaggagttc

SEQ ID NO: 179 - DNA, 522 bp, Porphyromonas gingivalis
atgaatggcgatatgaaacggtttttgattttgatcggctttgcactggcggtagctttctccggtttttcccaaaagttcgctttggtagatatggaatatatcctcaggaatattcctgactatgagatgatgaacgaacagctggaacaggtgtccaagaaatggcaaaatgaaatcgaagctctcgaaaatgaagcccaatctatgtataagaagtatcagagcgatctcgtattcttgtctgctgcacagaagaaaacccaagaagaggctatcgtaaagaaagagcagcaagcatccgagctcaagcggaagtatttcggcccggagggggagctgtataagaaacgctccgatctgatgaagcctattcaggatgagatttggaatgctatcaaagagattgccaagcgtaacaactatcagatggtgcttgatagaggtacgtccggaattatctttgccagtccgtctattgacattagcgaccttgtactgagcaagatgggctttagcaag

SEQ ID NO: 180 - DNA, 510 bp, Porphyromonas gingivalis
atgaaacggtttttgattttgatcggctttgcactggcggtagctttctccggtttttcccaaaagttcgctttggtagatatggaatatatcctcaggaatattcctgactatgagatgatgaacgaacagctggaacaggtgtccaagaaatggcaaaatgaaatcgaagctctcgaaaatgaagcccaatctatgtataagaagtatcagagcgatctcgtattcttgtctgctgcacagaagaaaacccaagaagaggctatcgtaaagaaagagcagcaagcatccgagctcaagcggaagtatttcggcccggagggggagctgtataagaaacgctccgatctgatgaagcctattcaggatgagatttggaatgctatcaaagagattgccaagcgtaacaactatcagatggtgcttgatagaggtacgtccggaattatctttgccagtccgtctattgacattagcgaccttgtactgagcaagatgggctttagcaag

SEQ ID NO: 181 - DNA, 489 bp, Porphyromonas gingivalis
atgaagaaattttttctcatgcttctgatggctcttcctttgagcctcttggcacaaaaggtggcagtggtaaacactgaggagatcatttccaaaatgccggaacaagtagctgctaccaaacagctcaacgaattggccgaaaagtatcgccttgatctcaagagtatggacgatgagtttgccaaaaagacagaagaatttgtaaaggaaaaagactctctactggagaacatccgcaatcgtcgtcagcaggaacttcaggatattcaaactcgttatcagcagtcataccaaacgatgcaggaggatttgcaaaagcgccaacaacagctttttgctcctatccaacaaaaggtggctgatgccatcaagaaagtgggtgacgaagaaaactgtgcctacatcatggaggccggtatgatgctttacaccggagctactgctattgacttgaccgcaaaggtaaaagcgaaactcggaatcaag

SEQ ID NO: 182 - DNA, 2481 bp, Porphyromonas gingivalis
atgaaggaagctattccccgaaagaacaagtatataaagctcaacggtatatacagattgtcattcattctgctatgctgcctgctatgctctcaggcagctatggcacaaggcgtcagggtatcgggctatgtgctcgaccgtggggaaaagccgatcccgttcgccggagtcaaagtgcgtggtacggggacaggcgcaacgacgaatctgaaaggatactacgagtttcggatgaaggccacgacggacagcatcacgatcgagttcagctccatggggtaccaaggggtaagtcgcagctttccgtctctgaccaaggacactcggctgaatgttcgtttggcagaggccgagatggagctttcgagcgtgacggtacaggccacaaaacgcagactcaacacgatggagcgcgtcaatacccgagaccttcgtgtcaatgcagggcctacgggaggggtggaatcgctcatcagtacctacgcaggagtaacgcagaacaatgaactaagctcgcaatactcggttcgcggaggaagctacgatgagaatatggtctatgtaaacggagtggaggtttatcgcccgctgctggttcgctctgcacagcaggaaggtctgagcttcgtcaatccggatctgacacaatccgtacagttctccgccggagggttcacggccgactatggcgacaagatgtcctccgtactggatattcgctacaagcaaccgcaggagaaggaaggagcggtactcctcgggatgctacaatcgagtgcctactatggcagcagtgccggagccttcagccaaatcacgggtgtacgctacaagagtgccaaatcgctcttgggcactacggacacgaaagccgaatacgatccgatctatgcggacggacagacattcatgacgtaccgtttcagccccaagctgtcggttagtttcctcggcaatatttcgcaaactcgctacaagtttgtccctcagacccgtgagacgagcttcggtacactgagcgatgccaaaaagttgaagatctttttcgacggtcaggaacaagatcgtttcctgacctacttcggtgccttcagcatgaacttcgtgccggacgacaaacagcggcatacggttacgctttcggccttcaacagtaacgaacgggagacctacgatattcagggagaatactttctgaacgatgtgcagctgggggcggacggaactgcttcgatggcttcgggctcagagaactccaacggcttgggcatcgggcgcaatcacgagcatgcgcgcaacaggctgagctaccgcgtgctgaacatgggttacagaggggagatgaagctgaacgagaagcatcgcctgcaagccggcgtatcggcacagatggagaaaatagccgaccatatcagcgaatgggaacggagggattcggtaggatacaacctacctcactcggagaccgtattgctgatgtacaataacctatatgccgatacgcagatgaggggaacgcgcttgtcggcattcgtacaggatcgattcaacttcagcatgggaggaggtacattttctctcattccgggtatcagagcttcgtggtggagcttcaacaaggagttgctcgtcagcccacgtatcagcgtgggttattctcccgaaagcaacccggctttggtactgcgtgcagccgccggactttattatcaggcaccgttttacaaagagctaaggcagacgcataaggatgccgaaggcaataacgtggttgtcctcaacgagaagatccgctctcagggagcttttcacattctcgcaggagcagactataccttcgaaatgggggggcgaaaatacaagtttacggcagaggcttactacaagagcctgttcaacatcaacccgtatataatagagaacgtgaagatccgctatctgggcgaaaacatcggttcgggttatgctgcgggtatcgatctcaagctcttcggcgaactggtacccggagtggattcgtggctgacggcttccattataaaagcccgtcagaaactggatggctacggttctttaccactgatgaacgcacccacttacaatttctccttcttccttcaggagtacgtgccgggcaataaacgcatcacagccaccctgcgggctgcactaagcggaggattgccccagctcaatccgagcaaagggcttagctcgccggcctttaccgcaccggcctataagcgtgtcgatctgggggtaatgtacaaatggctcgacccggatgactcctttgccggccgaagcaaatggctaatgggagtaaaaggggcctacataggggctgacctcttcaatctgttcgacatgaccaacgtcaattcttactactgggtgtcggatgcctaccaacagcaatacgccgtaccgaactacctgacacgccgccaattcaacctgcgtctcctcgtcgaattc

SEQ ID NO: 183 - DNA, 2016 bp, Porphyromonas gingivalis
atgtacagcggacatcataaaatccattatccttttcttatcctgttggtatgccttgcttttgctgcctgcaagagcgtgaagttgaaagatgcggagaaggcacatgatcgccaagagtataccaaggctgccgatatgtacaatacattatacaggcgtacccgacgaaagcaggtggagatgaaagcttatacggctttccgatccggtgaaaactatcgtgccgccggcagacaagccaaagctttgcgtggctatctgaatgccagacgctacgggtatccggattctgtggtactgctccgtttggcacagacttatcagcaaggaggtaactataaggaagccgaggtactcttccgtggatatctggaagcttatccgaaaagttattttgcagctatcggtttggaggggtgtctctttgcccgccagcaaaaggaatatcctacacgttaccggatacggcgagctgccgagtggaattcggcacggggcgacttcggcccggcctatgcacccgatgcttcggctctctatttcacatcgagcagaagcaaagacgacggtttggataatagcagcataacgggactgaaacccaacgacatttatatcatcaaacgagatgcacaaggacgatggggacgtcccgatagcgtgtccggaggaatcaacactccatgggatgaaggcgtgccaacgatcacgcccgatggtagtaccatatattatacgttggcgcagcaaggagccgattacgaccgtacggtacagatctattccgccgctcggagcggagaaggcggttggagcaacggttcgctcgtggacattatgcgcgattcgctccgtatggctgctcatccctctatgtcggcatccggcgattacctgtatttcgtcagcaatataggcggtagctatggcggcaaggatatttatcgtgtcaaggtgtcggatcgttcttatggttcaccggagaatttggggcctgatatcaatacgccgggggacgaaatgtttcccttcatagatggggatagtacccttttcttcgcttcggacggacacgccggtctgggaggactggatattttcaaagccacgctggactctaccggccaatggcatgtagtcaatatgggacaaccggtcaattcctctgccgatgatttcggcttggctgtggagcctaaaggcaaaaacaaagaagaagctttgccggacaacggagtcaaaggtgtattttgttccaaccgaggcgatgcacgcggatggccgcacctcttccatttcgaactgccggctatctacaccgagattcaaggttatgtgatggacagagaagaaaatcccatagccggagccactgtcaggatcgtaggcgaacgcggccccgtaggacagggattcgtgactactcgtgacgatggctcctataagatgagcgtgcagggcgatactcgctatgtaatgcttgccggagcatcgggttatttgaatcagtacgtagaactcaagaccgataccgccaagcagagtgagacctactatgtggactttttccttgcatcgcgtgagaaagccgagggcttgcaaaatattttctatgatttcgataaagctactcttcgccccgaaagcatgaagagcttggacgaactgattcgtatcctcacggacaatccggatattcggatcgaattgggttcgcatgccgacaggaaaggccccgatgcttacaacctcggactatctgaccgcagagccaaatccgtggtggattacctcacgagtcgtggcatagcggccgacaggcttacgtggaaaggctacggtaagtctgtccccaagacggtgacagccaaaattgccgaacggcacgatttcctgaaggaaggcgatgtgctcaccgaggaattcgtagcacctttgaccgaggagcagcagtcagtctgcgaccaactgaaccgtcgtaccgagttccgtgtgatcgaagaagagttgcgt

SEQ ID NO: 184 - DNA, 2124 bp, Porphyromonas gingivalis
atgaaaaagtttttcttcgcgctactatcgattggtatttcagcgcaggcttttgccaagacggacaacgtcccgacagattcgctacgagtacacaatcttcagaccgtcacggtctattctacacgcacggccgtacctctgaaaaagataccggccaagatggaactcatctcatcgcgcaacatcaagcagtccggctttaacaacatgaccgacatcctcaagacgcaaagttcgctcgatgtcatacaatacccgggctttagttcgaacatcggtatccgcggtttcaagccctccggcaagtatgtaaccgtattggtaaacggcatccctgcgggaacggacaatatctctacgctcaacacgagcaacatcgaacaaatcgagatcctcaaaggcccgttctcttccatctacggcaccaatgccatgggcggtgtggtgaacatcatcacccacaaatccaaggacaagatccatggcaacgtttctctcttcggcggtagctaccagaccatggccggatcattcaacttgggtggccgcttcgaggatattttctcattcgatcttagtctgggcttggacaagcagaacaaggactataagaccggatcaaacaatttcctatccctgagcaaactggaagaagctatagtagatgtaaatgctaccaaaaacaagaaaatgaaggggagcgactatactgtagcaacgggacgtctgcgtttcggtatcgacttcacgcccgaatggtcgctgaatctgtatcaaaacgtattcctcggagatgcgatccccgtaggaggatctatatggggcgtttacggagaatccaaaaaaaatctgaatcgttcttcgacctctttcgagctgctcggcaaacatggctgccacacgcttcaattctccccctacttcaacatagagaaatcggagaactataacaatgccgatcccaccggtttcatcaactacaaaagcgactactacacctatggtgccctactccaggacaagatttcctttggaggacaaaatatcgtactcggtgtcgacagccgaaacatgacgatggagtcagaaagattcgagcaggcaggagtgaatacaaagccatacaaccccggatatgccacgaacaatatcggtttgttcggacaggccaatttctacctgctgaacgatgctctatcgatatctgccggtgcacgtgccgacttcatgttctttgacctgaaagcgaacgagtatctcaacaatgaagccaaacaggaaactcataacgtaatcaatccgaatgtcggaatcaaatatgagtttgtgaaaggccttacagctcatggtacattcggtagtgcattcagtgctcccgatgctttccaaaaagcaggccaatacgtaggcccgttcggcacgaccataggcaatcctgacctgaaacccgaaaagtccatgacctgggacttcggtatcggatacagcaatgcacgctgcgggatccaagccgacgtaaccttaacctatttccacaccgaccacaaagatctgatcttgtccagccctgactatgctaataatatcaccacatacatcaatgccgacaaggctcgtatgagcggtatcgaggcccttttgtcttatgacttcggcagcctctttgccaacaagttctctctccgcgcatttgcgaatgccacgatcatgctcaattccgagatgaagaaaagccagaccgatgccccttggagcgaaatgtactacgttcgcaagcagaacatcaccttcggtatcgaatatcgtggcaaagaaggacttgaagtgatgctcaacggtcgcttcatgggacgcaggatcgagcaaaactggtatgcttactaccccgaagttcgccccgaactccagcaactgcttgcagcagaagagcctgaattggctgctcagggactgctccgtcatccgcaagcaatggtgttcaatgcctctgcttactaccacatgaacaagtatctcaccttcggtgtgaacttgaacaacatcttggatgagctttatacggagaaagacggctaccacatgcccggacgtaacatcatgggtaaggttatggtcaacttc

SEQ ID NO: 185 - DNA, 1386 bp, Porphyromonas gingivalis
atgaacaggttttcaaatcattggccctgcatcctcgtggggtttgtactctggtttgtatcggcgagtcggactgtggcacaaaacgcctccgaaacgacggtatcgtacgatacggataccgccgtactctccgaagccgatgtgcttcggatcgctcttagtgagaatgccacagtgaaagtggccgatatggatgtgcgcaaacaggaatatgcacgtagggcagcacgtgccgatctcttcccgaaagtagacctcaatggcgtttacagccatacgctaaagaagcaggtcttatatatagatatgcccggtttcagcagtagcgaaggtatcgaaatggggcgtacacacaatacgcaaggaggggtgaacgtctccatgccattggtgtcggcacagctttggaaaagcattgccatgaccggagaacagctcgatctggctctggagaaagctcgcagctcccgaatcgatttggtggcagaggtgaagaaggcttacctcagtgtattgttggccgaggactcttatggcgtattcaagcgcagctatgacaatgctctggccaattataagaacatatccgacaagttcgatcgtggacttgtggccgagtatgataagattcgagccaatgtacaggtacgcaacatcgagcctaacctcttgcaagcgcagaactccgtagcccttgctctctggcagctcaaggtcctgatgagcatggaagtggaaactccgatcagactctccggttcattgtccgactataaagaacaagtctataccggctattttgccgccgatacgcttatttccaacaactcctccctgcgtcagctcgatatacagcgtcgtctggctgtcagtgcagacaagctgaacaagtacagcttcctgcctacactcaatctgggagggcagtacacctattcgctcaacagcaacgacatcaaattctggggcgagggacaacgctggacgcctttctccaccatatcgctcagcctgtacattcctatattcaatggaggcaaacgtctgtacaacgtgaagcaaagtgctttatcgatccgtcagatcgatctgcaacgacgccacatagagcaatccatccgaatgggaatcaagaaccaaaatgaccgtctgcgtacctgtatgcagagatttgtggcctcggaagaggctgtccgaagtgcagaaaagggctatcagatagcagagaaacgctatcagacaggcgaaggcactctcgtcgagctcaacgatgccgatgtggctcttttgcaggctcgactcaattataatcaggccatattcgactttatgaccgcaaaggccgaattggacaagatgaacggcatggggattcccgaacaa

SEQ ID NO: 186 - DNA, 1476 bp, Porphyromonas gingivalis
atgtggggggacagccatggagtggcgccgaaccaagtgcgccgaacgctggtgaaggtagccttaagtgaatcccttcctccgggtgcaaaacagattcgtatcggattctctcttccgaaagaaacggaggaaaaagtcaccgccctatatctccttgtgagtgattctttagcggtgcgcgacttgccggactacaaagggcgagtctcttacgatagcttcccgatctcaaaggaagatcgtaccacagccctttctgcggattcggtagccggacgccgcttcttttatttggctgcggatatagggcctgttgcttctttttcccgatccgatacgctgactgcccgtgtggaagaggtggctgtcgatggccgccctttgccgttgaaagagctgtcgcctgcctcccgtcgtctgtatagggggtatgaggccctctttgtacccggtgatggcggatcgcggaactatcgtatcccggccattttgaaaacggctaatggaacactcatagcgatggccgacagacgaaaatataatcagacggatctgccggaggatatagatatagtcatgcggcgcagtacggacggagggaaatcgtggagcgatcccaggattatcgtacagggagaggggcgcaatcatggctttggcgatgtagccctggtgcaaacccaagcaggaaagctcctgatgatctttgtcggtggagtaggcctgtggcagtctacccccgatcgtcctcagcgcacttatatatcggaaagtcgggacgaaggactgacttggtcgcctcctcgggatataacccatttcatcttcggcaaggattgtgccgatccgggacgcagtcgctggttggcctccttttgtgcttcgggacaagggcttgtgctgccatccggtcgtatcacgtttgtggctgccatccgcgaatcagggcaggagtacgtcctgaacaactatgtcctctatagcgacgatgagggcgatacatggcagctttccgactgtgcataccgccgtggcgatgaggcaaagctttcattgatgcccgatggcagggtactgatgagcatacgcaatcagggacggcaggagagccgacagcgtttcttcgctctctcctccgacgatggccttacttgggagagagccaagcagttcgagggcatccatgaccccggctgtaatggagctatgcttcaagtgaaaaggaacggaagggatcaagtgctgcactccctgcctctcggcccggatgggcgtcgcgatggagctgtctatctcttcgatcatgtctccggccgctggtccgctcccgttgttgtcaattcaggatcgagtgcctactcggatatgactctgctggcggatggaacgatcggttatttcgtcgaagagggcgatgagatctcattggttttcattcggttcgtccttgacgatctcttcgatgtccggcaa

SEQ ID NO: 187 - DNA, 735 bp, Porphyromonas gingivalis
atgaaaaaagaaaaactttggattgcgatcgtcgccggtttggctttcgtattgggcctttatgctcttggccgcagtgtcgctcagctacgccgctctcagccttcggtgactgtgaccggtatggccgagcgtaatttcaaatccgatctgatcgtttggactgcttcgtaccagctccagatgatggatctcgaatcggcctacaaggctttgaaggaaaaacagatattggtagcagactatttgaaaaacaagcagctgcccgattcgtcttatatcttctcaagcgtagccatctctaaagaatacaactactattacgatcctcggcaggaacaaaacgtcaggacctttgccgggtatctgctcagccagacagttacggtgacctcacaggacatcgaacatgtggagaaaatatctcgcgatataacggagctgatcaatcagggggtagagattacctccgaccgtccggcctattactacaccaagctcaatgatctgaaggtggagatgctgcgcaatgcctccgaagacgctttcaatcgtgcttcggtcattgcggaggggagcggttcctccgtgggtaagatgctatcttcttcgatgggcgtgttccagatagtggggctcaactcgaacgaagattatagctggggaggttcgttcaatacgtcttccaagatgaagacggcaagcataacggttaaggcttctttcgctttgaag

SEQ ID NO: 188 - DNA, 828 bp, Porphyromonas gingivalis
atgaaaaaaacaattgcaattatcgcctcagccctcttggctttaggagccgtcggctgtaagaaaaatgctgacactaccgctgtcagtgaaaaggatagcatagccttgtccatgggtattttgtacggacaggattttgccaatcagttcgaaatgtcccgcttgcaaggccagccgattgattcggtagctttcttggacggtttcaaatatggtatcgatacgacgcgcttctcgtacaatctgggagccatctatgcttccaatatagctcgtcagctggctcatgattccatcgatatcgacaagttctatgcagccatgcgtgcggctcttcttaaagacaccgtatctatcgccatgaagcctgcagatgcacaggctttcatgcaacgaatccaagccaaaaagcagcgagaaaacaatatgaagcagtttggccagaacatcgaaaagggtaatgaatacatcgatacctttaaaaaagaagatggtgtaactgttacgacaactggtctggcatacaagactcttcaggaaggtacgggagctactccctctttggccgatactgtacgtgtcaagtatgtgggtactctggtcgatggtaaagagttcgacaaaaacgaagaaggaatcgaatttgccgttaccggtgtgattaaaggctggacggagatgctccaactcatgaaggtcggtcagaaagttcgcgtggtaatcccacaggagctggcttatggggagaccggcaactataccatcgaaccgttctctaccctgacgttcgagatggaacttatcgggatcaagcccgggaaaaag

SEQ ID NO: 189 - DNA, 2325 bp, Porphyromonas gingivalis
atgaaagtattacggcaagtattcctccccatcctttttgtcctactgacaggtgcctgctccaccacaaagaatctgccggaaggcgaacagctgtatatcggaatgggcaagacacagatactccggcaggacaagagccacgccggccaacaggctctgaccgaagtggagagtacactgaaagttacacccaatggagctattttcggcagtgcaagtgcctccttacccaagataccattcgggctatggctatacaacagcttcgtgggggattccactgtcatttcgaaatggatattcgacaagtttgcagccaagccggttttcatcagtcaggtcaaatccgatagccgggctaaggtggcgacgaacatcctccgcgaacacgggtacttcgatgctaaagtaaaaagcagtgtgaccactctgaaaaaggactcgctcaaagccaaaatctcctatacggtggatatggcctctccttatcattacgacagcatcattcccttaccgatcagcactttccccgacagcattctggcttacaggcagactccgtctttgatcaggaaaggagaccagttcaatttggcaaagctgcacgaagagcgtcagaccatcagtgccctgctgagagacaatggttactactacttccgcccacaggatattatctacgaagccgataccctcctcgtaagaggtgccgtatgcctgcgagccaagctctcggaagatactccaccccaagccatgcgcccgtggaggatagggaaacggacagcagtcctgctcggaatgaacggagaaagcccgacagactcgctcgaagtggaggatatgaaagtcctttactatcgtaaaatgccggttcgccccaagattttggccaaacgctttcgtttcttctccggcaatctgtatcggcagaaagacgatgagacgacacgcaaatccttggctcgtttgggagccttctccgttatcgatctcaattttttgcaacgcgattccatttccggccttttggatgtgcgactgctaaccaccctcgacaaaccttgggatgcatcattagagaccttgttcacgagcaaaagcaatgacttcatcggtcccggactgaattttgctcttgctcggcgcaatgtattcggcggaggagaaaatctttcttggaatatcggtggatcgtatgagtgggagaccggcaatcgtcccgaaaatagcagcaatcggctgatcgatataaattcgtacaacatgaatacggccgtgaacctctcgtttccctcgattgtatttcccggtctgctggataaatactattactaccccacgactacgacttttcaggcttctgccaccgcgctgaacagggcacactactttagcatgtactctttcggcttttcgaccacctacgaatttcagccctccaaggaacaccggcatgctattttcccgctcaagctcaactacaacctcctggggcatcagacagaaactttccaggccattacggcgaacaatccgcccctgctgctcagccttcagagtcagttccttgctcaaatggggtatatctatacgttcaacaaatccgtttcagagaaaagtcctcatcatctttggatgcaattcggactatccgaggcaggcaatctcctgaatctgatctatctggcagccggcaagaagtacagcgacaccaagaatttcgtcggcgtccccttctctcagttcatcaaagccacgggagaactgcgctattcctataccatagaccgcaatcagtcactggcaacccgtttcgggacaggcgtgatatatagctatggcaatatgcgagtggcaccctatagcgagcagttctatgtaggcggtgccaatagtatcagagctttcaccgtccgtagcatcggccccggacggttcaatccggattccgacaatcagtattcctatttggatcaggtgggcgaattcaaactcgaagccaacgtggaatatagaggcaagcttttcggggatctccacgcagccgttttcctcgatgcgggcaacgtttggctcttgagggaggattcttcccgtccgggcggtgctctgtccgaagtgggatcggtgagcaatttcctgaatagcatcgctctcggcaccggtgtcggccttcgctacgatctggcatttctcgtggttcgtgtcgatgtcggcttcggtctccaccttccttacaatacgggtaagaaaggttactacaatatcccacgctttaaggatgccatcggtttccatttggctgtcggctatcccttc

SEQ ID NO: 190 - DNA, 2322 bp, Porphyromonas gingivalis
atgtcctcgcattccgttcggtatctaatcggcattgccggctgcttgctcctcatgcttgcttcctcctgctcggtcacccgttatgtgccggacggtagcagactattagacagggtaacgatcgcaagcgaaacgggcagtatcgctctgccggaagatattcgggactataccctccagcaacccaattacagactgttcgggatgactcgctggctactgcgcgtctatagcagctcgaatccgaacagcaacagctggtggaaccgttcgctccggaaaatgggcgaaccgcctgtcctcatcgattctgtcctcaccgatcgtactgccaaccgtctggcaaaggcgatggccggcgatggctttctcgatgctactgctcgtgccgtggtagacaccggcttgtacaagaaagctcgcattacttatctgattcagcccggaagccgttattatatacgcaatatggctttggatgtgaagaatccactccttcctcccgttgcgcttggcaattcgcttccttcggcatacaaggtcgggatcagcgagggttctcccttgtcgcccatcgtactcgatgaagagagaaaggcgatagctcgtcatatgcgcaacaacggcttctggaagttctccgccgaggatgtttattatgaagcagatactaccgtttcaggaggatcgggtacgaaatctgccgatctgaaattagtggtcaatggcatcgggcgttatccatatcggatcggcagggtattctttcatgccgattatgatcctctcgaatcggacttcagagttcaggagctgccacgtatcgattcgatttcgcgtggcgattacactgtttactatgggagtaggggacgttatatccgggcatcggctctcacgcggtcggtgtccgttacaccgggagcttttttctgcgaggatgatgtggaacgctcttatatcaagctgaatgcgctccctatcgttcggaacgtgaatatccgatttgtggagcacaatggtaaggatgagattgctctggcggatagctctcgccttgtggactgctatattcttaccgttccggccaagagcaaatcgttcgaagccgaagtcctcggcaccaattccgctggagacttcggggcggctttgtctctcggtttcaccgatcgcaatttgtttcgtggggcggagatgttcaatatcaaactcaagggtgcttacgaagccattcgcaagggttcgcacagcttcatggaatatggggtggaaagctcgctccgtttccctcgtctcctcttcccattcatttctgacgaaacgcgccggcggctacgggcatccacggaatggaagatcgggtataattaccagacacgtccggagtttgatcgggtgattctctccgctcaactcaattattcatggcagacctacctgcacaatcgtctgcgtcatacgatccgcctgctggatgtcgattatctccatctcccgtacatcgatcccgacttcgcccaatcccttccgcctacgactgcactgtataactacacggagcagtttatcctcggctcggcatatatactgaactataccacggcttcgtccatggagcgtaccgtatccaatccttttacggcacggttcagtatccagacagccggcaacctgctgcaagccatttcttatctgaccgattctccgaaagacgaacacgggttgtataaaatgttcggtctgcactatgctcagttcgtcaagctcgatctcgatctggctaaaaccgttcttctcgaaaaggacaatactttggcactgcatctgggtttcggactggctttcccttatggcaatgctcgccatataccctttgagttacgttactttgccggaggatcgaacagcgttcgcggctggagtgtccgtaccctcggcccggggagtatgaagatgactccggacaagaccttcttcgatcagatgggtgatattcgtctggatctgaatgtcgaatacaggacaaagctgttctggaagtttcgcgcagcagcttttgtcgatgccggcaatgtctggacgataaaggagtatgagaatcaggaggacggtctctttcgtttcgatcgcttctacaaggaaatagctttggcctacggtctggggcttcgtctcgacttcgattatttccttgtgcggctggatgccggactgaaagcctacgatcctcagcagacagggcgttacaaatgggctatcacacgcccaaacctttcttccaatttcgcttggcacattgcagtaggctatccgttc

SEQ ID NO: 191 - DNA, 2601 bp, Porphyromonas gingivalis
  modified_base (1150)..(1150): n is a, c, g, or t
atgagaaaaagaattctacaacttttcctgaccgcattgctgctggcattaggctcctctctcgccatagcgcaaacagtggtgaccggtaaggtgatcgattcagaaacgtccgaaccgctcatcggtgtatccgtaagcaccggtcagggagcatccctccgcggtgtaaccaccgatatggatggtggcttccgattcgaagtaccggccaaatctgtcttgactttccgttgcgtaggttatgctaccgtaactcgctctataggcagaggttctcaagaagacctcggtacgattctcctcgatccccaggccatcggcttggatgagattcaggtaatagcctctgtggtgcccaaagaccgtatgacgccggtacccgtttccaatatccgtgtggctgatattcaggcagcatcgttgaatgtcgaatttcccgaactggttaaatccactccctctacctatacgacaaaaggaagcggaggtttcggtgatggtcgtaccaatgtgcgtggattcgacacttacaacttcggtgtactcatcaacggagttcctgtcaatggtatggaagacgggaaagtatattggagcaattggagtggtctgatgaatcaagccagtaccattcagattcagcgcggactcggagcctccaagctcggtatcagctcggtaggtggtacgatgaacattatcacgaagactacggacgccaacaccggaggttcggcttatgtcggtatgggtaatgatggattgcacaaagaatcgttctccatttctacgggtatgaacgacggttgggctatcaccattgcaggctcccatatgacgggtctgggttatgtgaaggggctgaagggacgtgcattctcttacttcttcaacgtttcgaagaagttcaatgaacgtcataccctctctcttaccggattcggtgcaccacaatggcacaaccaacgttcttccaaatattctgtagccgactatgacaaatacggcatccgtcacaatcaatccttcggctatctgcgaggcgaactgactcctacggcttatgcttacaatacgtaccacaagccccagttctcgctgaaccacttctggaagatggatgaaaatacctctctttataccgcancctacgcatctttggctaccggtggaggtcgtcgcgcttatggaaagaacagtaagtgggtattgatcaactacaacaccggacaaccctatgaacaaacaaaggtgactcccgatggacttatcgactacgatgccgtactggctgccaatgctgcggcgagcaatggctcggaagcaatttttgcccttggctccaactctcacaagtggttcggtctactctcttcattcaagaagaaacttaatagttcgctgactttgacagccggatacgatgggcgttactaccgtggcgaccactatgacaagatcaccgatctgctcggcggtagctactacatagaggatcccaagacaaagctcgcataccatgcggaaggtcagcaactgaaagtgggtgacattgtaaatcgggactacacaggcgaaatcatgtggcacggcctcttcgcacagatggagcattcgtccgaatggatcgatgcattcgtatcaggatctatcaactacgaactataccgcaatcacaactatggcggtagcaagtccaccggctacctgcccggcgtatcgccgtggaaaagcttccttccgtggagtggcaaggcaggtctgagctacaagttcgcacagggacacaatgtattcgccaatggcggtttcttcacacgtgcaccactctttggcaatatctatgctgcgggggctatcattcccaatgacaaagccaatatggaaaaggtgcttacaggagaggtcggctatggattcacgaatcacaaaaacttcgagttcaatatcaacggatactatacgaagtggatggatcgcgtgacctcgaagagaatcggaaacgagtatgtttatctcaatggcgttgatgctgttcactgtggggtagaggctgaggtcagctatcgtcctattcgtcagatcgaccttcgcggtatgttctctctcggtgactggacttggcaaaacaatgtaagttacacttcttacgacgaagccggcaatgagacagggcaggatataacctatatcaagggtcttcacgtcggagatgcagcacagatgacggctgctgtatcggcagacatagagctgttcaagggtttccatgtcataggtaagtacaacttccttggcaagaactatgcaggattcaaccccgcaacgcgtaatgcacagcagtacgaagcggatggcaaagaaatcgtggaatcatggaagttgcccgatgtaggtctgttcgatctgtctgcatcctacaatttcaagcttggttcactcagcaccacattctatttcaacatggacaacgtagccgacaagcgatatgtgagcgatgccgacgacaatatcatcggtaagaaacacgatgaggcttcggctctcgtatggtacggtttcggccgcacttggtctaccggtattcgtgtaaacttc

SEQ ID NO: 192 - DNA, 1293 bp, Porphyromonas gingivalis
atgaagttttcaatccgccttttcctctgcatcatctttctcctctctgcatttatcctgcctgctctcggacaaaaatccaagcaggtacagcgacttgagaagcaacgtaaggaggccctcaaagccatcgaaaaaaccgatcgcgaactacgaaataccaagaaagacaagcaagacaaacaaaagcatctcaacctcctgaacaagcaggttgctcaacgcaagcagatggtacaactcttggacaatgaggtcaaagagttgcaatccgacattgattccatgacgggtgtatgtcatcagctctctgtagaagagaaagcccgatccgatgaatatgcccaagctctacagtctatgcaaaagcggaaacgctcgttggatcgcatccttttcatttcatcggccaagagctttgacgaaggcatgcgacggatgcgtttcttggaacaatacgcttctgcatacaagctggcatctgtccggctgcgcgatacacgtagcaagttggagactgaacgtgcgactgtagaagacgccaaaaaggagaaaggacatctcttagtcatcagagaagaggaaaaaaagaaactcgaaggacagcaagccgagcaacgtcggcaggtgcaggctttgggagccaaacaaaaagacttggaagcgcagctgcgaaagcagaaaaagcaagccgaagctctgaacagaaagatcgagaaacagattgccaaggaaatagaagctgccgaacgtcgtgctcgagaagaacgtgaacggttggcacgcgaagccaaagccaagggtaagccggttcctgccgaaccggaacggaaggcggagaccaaaggcggctatgctatggatgcctctgagcgtgctctctcgggcagctttgcacagaacaaaggtcgcctgcccggccccgttcgcggcagataccgaatcgtaagcgactttggcgtgcatcagcacagtgagctgaaaaaagtacaagttaataatggaggtatcgacatcgctgtagcaacaggatccgatgctaccagcgtattcgatggtgtagtgtccagtgtattcgtgatacccggttataattcggccgtaatggttcgtcacggtaactatatcacggtttatgcgaatctgagcaaagtgtatgtaaattccggcactcgtgttaaaacgggtcaggctcttggtcgtgcctatacggatccttccaacaaccagaccattattcacttcgaaatctggaaagaacgcagcaaacaaaacccaagactatggttacga

SEQ ID NO: 193 - DNA, 999 bp, Porphyromonas gingivalis
atgaaaaagtatttgttatatgcctcgttgctaacgagtgttttgctcttttcctgttcaaagaacaatcctaacgagccggtggaagacagatccatcgaaatttctataagggtagatgatttcaccaaaacgggtgaggcagtacgctatgaaaggaatcaaggaagtgctgccgaaaggctcattaccaatctttacctcttgttgttcgatcagtcaggggcgaatccggcgaaatactatattaccggtaacactttcaccggagggacctggcttcctgacgatatgaaggtgaagttggatatgacacaatccgaggccggagagcgcaaagtatatgtcgtagccaatgttgataatgcggttaaaacggctcttgatgctgtcgctaacgaaagcgatttgcagactgtaaagaggacgactgcaatgccgtggtcgaccgatatagcctctcctttcctgatgtccggaaacaagacacacgacttcttggccaatcgtcttttggacaatgtgccccttgtgcgtgccattgccaaggtggagctgaatatctcgctgagtgagaaatttcagattgtgccgataattgtcaatggtagtttgagtgagttcaagttcagatacgtaaacttcgacaaggagacctacgtagtgaagccaacgaccaagccggacaatctcattagttctgctaatggtgtttggcctcagattacagattggactgtatggggtgcttccttaaatacttctcctgctccggatgcgggcacaggttatacattggatgcaaatggcaaggtaacggcactacggattgttacctatctgaatgagcgcgatagcaaaggggctacggtagaggtcgcattgcctcgtgtggatgatggcacccttcctcctccggaattcggtccggagctttatcgtttgcctttgccggacaagatcctgcgcaatcattggtacaagtatgaagtcgagatt

SEQ ID NO: 194 - DNA, 945 bp, Porphyromonas gingivalis
atgatcagaacgatactttcacgatatgtatcctcgaacttttggagtcggggagctaccttttttttcacgattttcccggccttcatcctcgccgctactgctttgccggcttgtggagggggtactgcttcaggctccgatcgtacgctggctgtgaccatcgagccacagaaatacttcatcgagtccattgcggataagtcggtgcaggtggtggcattggtaccggccggcagcaatccggaggaatacgacccttcgcctaccgtgatgaagcgtttgtccgaagcagatgcctacttctatataggaggactggggttcgagcaaagaaatctcgctgccattcgggacaataaccctaagctccctcttttcgaaatgggcaaagccttggcggatgccggaagtgcagatctccacggctcctgcacagatcattctcatacagacctgcatgcccatgatccgcactattggagcagtgtggtaggggcaaaggcactcagtcgtgctgcatacgacgcgcttgtggagctttatccgaacgagaaagacaaatgggacaaagggcacgaccgtctcaacggacgtatcgacagcgtgaagagactcgtcgataccatgtttgccaatggcaaagcagacaaagccttcgtcatatatcacccatcgctcagctttttcgcccaagagttcggcctgcggcagatcgtcatagaggaagatgggaaagagcctacggctgcccaccttcgtcgtgtgatcgatcaggcacgtgccgatggtgtcagaatcgtatttatccaacccgaatttgaaacgcgtcaggcggaggacatcgcacgcgagatcggtgctcgtccggtaaggatcaatcctctgcgcagctcgtgggaggaggaaattttacatattgctcgcgctttggctcatgaacgg

SEQ ID NO: 195 - DNA, 2544 bp, Porphyromonas gingivalis
atgatcggaaaaaaaatcttttttatcctgctggcgctcattgcgttcagtgggctgaacgcagcgacagacactgagttcaagtacccgaccgatgccaatatcatcggtcacgtcaaagacagcaagacgggtgaacaccttgtcggtatcactattgctatcaaaggcactacctttggtacatctacagatgcaaccgggcactactatcttcgtaacttgcgtccgggtgagatcactttgattatgcgtggcatgggctataagagccaggagcgcgtagtccgcgtagaaaaggacaagactatcgaggtgaatttcgaagcagaagaggatgccatcaatctggacgaagtcgtgatttcggccaaccgcgaactgacgcttcgccgtcttgctcctactctggtaaatgtattgaacgaaaaagtcttctcgcaagtcaatgcttctaacctggctcaaggcttgtcattccagccgggagttcgtgtagagaacaactgtcagaactgtggtttcaatcaagttcgtatcaatggactggatggtcgttatgcacagatcctcatcgacagccgtcccatcatgagtgcccttgccggtgtttacggtctggagcagatccctgccaatatgatcgaacgtgtggaggtagtacgtggtggaggatcggccttgtacggttcttctgctattgccggagtggtgaatatcatcaccaaggaaccttctcacaattctttcacattcaatgaatctctgagctttaccggtttcagcaagctggataacaacacgaacttcaatgcctccatcgtcagcgatgacaaccgtgccggtgccatggtattcgggcaggctcgttaccgcaaccattgggatgctaacaatgacggttattccgaattgggtaaaatagatgcccgctcgctgggagcgcattcttatttgcgcttgagcgactacagcaaattgacgggagagtttcacacgatcagtgaattccgccgtggtggcgatcgtatcgatttgcctcctcacgtagtgggtgtagctgaacaaactgaccatagcgtatttagcggaaacttgaaatacgatctcttctcttccaactataaacaccacttccaggcttatacttccggacagatcgtaaatcgcaagagctattacggaggtatcggagagattgacgtcaatggccaccccggtggtacggaaggctaccctatccctcaagatcaatacggcaataattatggcgtgaccaaaggcaagacatatatgggcggtatccagtacagctacgacttggacaaattcctcctcatgccttcgcaacttttgttcggagccgaatatacgcgtgatgaactcaatgacgtgatgcccatcctttcatggcagaccggcgaggatgccaatgggaataccattcccctctatcccgaattggatcagaatatcaacaactacagcctattcggtcagaacgaatggaaaaatgacagatggagcatccttgttggcgctcgcttggacaagcatagcgaagtcaaggatatgattctgagtcctcgtaccacactgcgtttcaacgtgaatccggacatcaacctgcgcgctacatatgcaaaagggttccgcgcaccgcaggtattcgatgaagacttgcacgtaggggttgtaggcggtgaggcacagaaagtattcaacgatccgaacctcaagcctgaaatttctcatgcattcagtttgagtgccgatatgtatcatcgtttcggtaacgtccagaccaacttccttgtggaaggcttctatactcgtttgctggatgtattcaccaacgaggagcagcctgatcagcacgatggcatcaaacgctacacgcgtatcaacggtagcggagccaaagtattcggtctcaatctggaaggtaaggtcgcatacaagtccttccagctccaagccggtcttaccctggccagcaacaaatacgacgaagcacaggagtggggtctgaatacggtgaaagacaccaacggagcttttgttaccgaggccaatgcaaatggacaacaggaatacaagaacgaatccatgacggatacgcagatcacccgtacccccagcgtatacggttattttactttggcctacaatcctgctcactcatggaacatagcccttacgggagcatataccggtcagatgtatgtaccccacgctatcgaatatggtgtgaagtctgccgaactggatattatgcagaacaatcctgagattaccgacgaaaccggaaaggctccccgtattgatgagctgaagaagacacctgcattcttcgatttgggcttgaaagtgggttatgacttccacgtattccaggctactgaggttcaactctatgtaggtatgaacaatatcttcaactctttccagaaggacttcgatcgtggagctgcacgtgacagcggatatatctatggtcctacgcagccgcgtacaggctacatgggcttggtagtgaagttc

SEQ ID NO: 196 - DNA, 606 bp, Porphyromonas gingivalis
atgacagtaaagcgcgcagtgcgaatagcacttctcacgctgataggcattcttttttcctcaccttctcttgttcgggcgcaaagtcttttcagcaccgaacatgtcttgcaactatacaacaagatactctatggagagtcggcggcggataccgtcgcagagaaaacggcaggtgagtcggcatttccttttatagacaaactcatcaatctcggccgcactttcctcggcaaaccatatcgctatcgcggtccttccccatggccgatggactgctcgggctatgtgtcttacctctactccaaattcgacatcaaactcccacgtggtgcggcagcacagagccaatatacgaatcctatcgagcgcgaggatgttcgtccgggcgacctcctttttttcaaaggccgcaatgcacgcagcaaccgtatcgggcatgtagctttggtcgtatctgtcgatgaagatgatattaccatgatgcacagccgcaattcgcgagggatcgtgatcgaaaaactcaatcgcagtgcatacttctcccgtcgcttggtgagctatggcagggtacccggagccaagagagtgatcccacgaaaaagt

SEQ ID NO: 197 - DNA, 1365 bp, Porphyromonas gingivalis
atgaaacggacaatcctcctgacggcactgaccgtcctatcttcgctctccttgcttcgtgcacaaaatgaatccgaagcatcaaccaatccgatgtcaggcctctccctggaagactgtatccggatagccaaggagcgcaacctgaatctgcgcagacaggagatcgaacaagaaaaccgaatcattagtctcgatgcagcacgacacagtttcctgccctcggtcaatgcaggcatcggacacaactatagcttcggacgttcgaaagacaaaacgggagtaaccgtagatcgctcctcgatgaataccaatctcagcatcggagcttcggtggaagtattcagcggcacacgtcgtctgcacgacctcaagcagcaaaagtacaacgtggaggatggtatagcccgacttcaaaaagcgcgtgaagacctcagcctgcaaatcgcggctctctatatcaatttgctcttccgtcaggaaatgactcgtacggcagaaacacagttggcactgattcgcgagcaacgcaatcgcacggccgaaatggttcgcgtaggtaaatgggcagagggtaagctcctcgacataaatgcccagatggccaaggacgaacaacttctcgtacaatatcgttcggaggaggagctggctcgtctggacttggggcaagccctcgaactggagcaccccgaaagcattgcagtcaaggctcccgacacagacgttctcgtagcagaaaggttgggatctctccttgctcccgaagagatctatcgcacggctctcggcttgaaaccggcactgcattcgagcgagctgcaaatagcttcggcacgcgaaggtctggcctcggctcgtgcggcatacttcccgacgctcagcctctctgccggatacagcaacggttacttccgcgacctcggcaaggagtatgccgccatcaacccctccttctccgaacagtggaagaacaacggcagctacagtatcggactctctttgaatatccccatcttctctgccatgcaaacgcaagatcgcgttcggagcagtcgcctgcaaatacgctcaagcgagcttcgactcgtcgaagagaaaaaagccctctataaagagatcaggcaagcatacagcaatgccgtggcagccgataaggccatcgcagcagccgaaaacagcaaggccgctacgctcaaggcatacgaatacgctcgcgacagcttcgaggcagggcgcttgtctgcctacgaatatgccgaggcaaaaacaaaatacgccctcagccaagtggaagaacttcgtgccaagtatgacttcatatacaaagccaaagttttggatttctatcagggcaaagacttc

SEQ ID NO: 198 - DNA, 1332 bp, Porphyromonas gingivalis
atgcgtttccaacattatctcatctgtacggctgccgtagcggctttggctgcgaatccccttacgggccaatcgaatatgaccctcgaagagtgcatagactatgcacgccggcacagttcggccgtggcgctgtccgctgcggaactggagcagtccaaggccgattaccttcaggccgtcggcaattttctgccccgtgtatcggccggaaccggtgcttcgtggaatttcggacgcggattggatgccgagacgaatacctacaccgacatcaacagcttcaacaattcgtacagcatacatgccacgatgacccttttcgacggtttgcagagtgtctatcgactgcggatggcgcatgcacgccgggaggcttcgcgcctctccgttcgcgagcagcaggagctggcagctctcggcaccacggaggcctactacgacctcgtctatgcgcgccaaatgcaagagctggccatgcagaagtacgaggagagcagccgcctccaccggcagacggctcgaatggaagagctggggatgaagagtcgtcccgatgtcctcgagatgcagtcgcgaatggccggtgaccgtttggccctgactcaagcggacaatcagtgcatcatcgctctgatccggctcaaagaaaaaatgaacttccccatcgatgacgaactcgtcgtagacgatatgccggctgacagtctctccgccgacatggccgaatcggacagctcggccggcgtcttcgcccgtgctgcccatcatcatcccgtcctcctccgtgccaaactcgacgagcaggctgccaccgaccgtttgcgagccgcgcgaggtgcattcctgccgagtgtgtcggtatccggaggatggaacacgggattctcacgctttttgaatggatcggactatacgcccttcagcgagcagtttcggaaccgtcggggggaatacgtcagtctgaatctgagtatccccatcttttcgggattcagccttgtgagccatctgcgtcaggcgcgtgccgaacgcagggcggcaatcgtccgacggggcgaagcggagcgcaggctctacagcgagatcgcccaagccatggccgaccgggatgccgctctggcttcctaccgccaggcgaaggagcataccgacgccatgcaaaccgcttacgaagccgtcttgcagcgttatgaggaggggctgaatacggccatcgacctgaccactcaggccaatcggctcctggatgcccgtgtgcagcgactgagagcggccatgacctaccggctcaaatgcaaactcatagcctattacggctgcctttcggac

SEQ ID NO: 199 - DNA, 2820 bp, Porphyromonas gingivalis
atgaacaaattttacaaatcacttttgcagtcaggactggctgccttcgtgtcgatggcaactgcactgaccgcttctgcacagatttcgttcggaggggaacccttgagtttctcttcaagatccgccggaacgcattcattcgacgatgcaatgactatccgccttactccggatttcaatccggaagacctgatcgcacagagccgttggcaatcgcaaagagatggccggcccgtccggataggacaagtaataccggtggatgtggactttgcatccaaggcttcgcacatctcttccatcggagacgtagatgtatatcgcctgcaattcaagttggaaggagccaaagccattacgctttattacgatgcattcaatattccggagggcggacgcctctatatctatacccccgaccatgaaattgtgttgggagcatatacgaacgccactcatcgccgcaacggagcttttgccacagagccggtaccggggagtgagcttattatggattatgaagtgtctcgcggagggactttgcctgacatcaagatctccggtgcgggttatatattcgacaaagtcggcggacgccccgtaacggataaccattacgggatcggtgaggacgattccgattcggattgcgagatcaacatcaattgtcctgaaggtgcagactggcaggcagagaagaacggtgtggtgcaaatgatcatggtaaaaggacagtatatctcaatgtgctcaggcaacctgctcaataatacgaaaggagactttactccgctgatcatttctgccggacactgtgcttccataacaaccaatttcggtgtaacgcaatccgagttggataagtggatcttcactttccactatgaaaaaagaggatgcagcaatggtacattggccatcttccgtggcaacagtatcatcggagcttccatgaaggctttcctcccgatcaaaggtaaatccgatggtctcttgctgcaactcaacgatgaagtccctctgcgctatcgtgtctattacaatggatgggacagtacgcccgatattccctcgagcggtgccggtattcatcatccggccggagatgccatgaagatttccatcctaaagaagactccggctctgaatacatggatctcctccagtggttccggagggactgacgatcacttctatttcaaatacgatcaaggtggtacggaaggaggatcgtccggttcttctctcttcaatcagaataagcacgtggtcggcacactgaccggaggtgccggcaattgtggcgggacggagttctacggcagactgaacagtcattggaacgagtatgcatccgatggcaatacgagccgcatggacatctatctggatccccaaaacaatggccagacgaccatcctcaacggaacgtatcgtgacggttataagcctttgccctctgtgccccggctattgttgcagtctacaggcgatcaggtcgaattgaattggacggctgttcctgccgatcaatatccatcatcttatcaggtcgaataccacatattccgaaatggaaaggaaatagctacgacaaaggagttgtcctattcggatgccatcgacgaaagtattatcggtagcggtatcattcgatacgaagtaagcgcacgcttcatttatccctcgccgttggatggagtggaatcttataaggatacggacaagacttctgccgaccttgccataggagacattcagaccaagctgaagccggacgtaacacctctccccggaggaggagtatcattaagctggaaagttcctttcttaagccagttggtttcccgattcggagaaagccccaatcctgtgttcaaaacctttgaagtgccctatgtttctgccgcagccgcacaaacccccaatcctcccgttggcgtagtcattgcagacaagtttatggccggtacatatcccgaaaaggctgctatcgctgccgtttatgtaatgccatccgctccggactctactttccacctcttcctcaagagcaacacaaacagaagattgcagaaggtgacaactccctccgattggcaggccggaacatggttgaggatcaatttggataagccgttcccggtgaataatgaccatatgctttttgccggtatcagaatgcctaataagtacaagctcaatcgtgctatccgttatgtaagaaatccggataaccttttctccattaccggtaagaagatttcatataacaacggagtctctttcgaaggctacggaataccctcgctcttgggctatatggctatcaaatatctggtggtaaataccgatgctccgaagatcgatatgtcgcttgtacaggagccttatgctaagggaacgaatgtggctccattccccgaattggtcggcatatatgtctataagaacggaacatttatcggcacacaggatccatccgtcacaacttattcggtttcagacggaacagagagcgatgaatacgaaataaaactggtatataagggatcgggcatttcgaatggcgttgctcagattgagaataacaatgctgtcgttgcatatccgtctgttgtaacagatcgtttcagcattaagaacgctcatatggttcacgctgccgccctctactcattggatggcaagcaggttcgttcttggaacaacctccgcaatggcgtgacattcagtgttcaaggacttacggccggtacttatatgctcgttatgcagacggcaaacggccctgtgagccaaaagatcgtgaagcag

SEQ ID NO: 200 - DNA, 2010 bp, Porphyromonas gingivalis
atgaaatatcttatcagactcttcttatcattgatgttactctctctctggacgggctgtacacacgaggagctctctatttgcgatggcgagaatacgcttgttttacgcgtagagaccggtaaagccccaaatgctcgtgccacagaacccggtcagggcatatacaatgagaataaagtaggctccatttctgtgctcttctatttagagggacaacttcgttggcaggtgaagtctacagactatcaaatccatgaaggggcctatatcattccggtcaaagagcaaatgcgaccactattcaatggcaacaacaacttcagcatctatgtagtggccaatctcgatttcaatgctccggccacagaagctgcgctttctcaatttgtggtagagaaatctattgaagtctcttctacgacagcccctgccgatttcgtaatgcttgctcatggcaataagcagatcaatatggctacgacagaagggaaactgttgggggattataaactcaaacgagtggcagcaaagattcgcatgataaaacccaccatcaatgtgcaaggatatgaagtggtcggaaatatacaggcaaagtttcgcaattcggtaacgaaggggttccttaccacagaagctcaagagatcccagctgctgcatcctataagacatcggaatatcttgatattgcagagtcggcacctgccaattctatccatttctattcttactataacaaatggacactctccacaccggagaagcgaccggaattcttcatcatggtcaaattcaaaaagacaggacagccggacaacacagccaaaccgtactactacagagtgcccctcgaatctcaggacaatcaggtcaagagcaatgtcctctataatctgaatgtgaaaatcgaaatcttgggttctttacaagagccggaagctgtttctgtaaacggcacactcgcaatagaagaatggattctccatcaggatgcattcaatctgcctgccaccaattacttgatagtggaacagcacgaaatcttcatgaataacgtgaacacatactcggtgaaatatcaaacttcgcagaaaccaatcagcattagcatacagtcagttacctttagctacgtctcttctgatggcactcagcacaatgatcttgtagcaagtagtagcgaccagtatcctacgattacaagcgataatacaagcatcataatcacttccaagataccggttaataacgtaccaaagaagatcgtttttgaggtaactaatggggtagccggtttgaaagagactgtcacagtactccaatatcctgcacaatttattgtcaatacacttggcacagcatcggcatggagaccagacggatctttggctccggggcttaacaataaagcgatttaccatgtcgtagtactggttccacccgagaatttatttgaagatgggacacagacaatcatcggttatccccccactgaaacaatttcttttcataagaaagagaacaatacctatccgatagtatggtctgacacaaatacgacaaaacaggaccttgagacatcaagaatgatttcaccttcctttgagttagcctcccaacttggggctactctcccgatgccctatctcgagtattggccagggacatcatatctccttgactattcgggaaactataataataagagatacgccttgtttaattgcgctttttactgggagaaaagaaaagttaataacgaagaaattaaattcgatgactggcgtttgccgacagaagctgagatcaaattgatagataagctgcaacataatgagcagagtgctgtccaagctatcatgacagggaattattattgggatagttactctgcaaatgggtcttataaaatgcaaggaggagggggccaaggaaattcctccaaagcctatgttcgttgcgtgcgggatgtgaaaaagccgattcgtgacaagaagtcaggtaag

SEQ ID NO: 201 - DNA, 3846 bp, Porphyromonas gingivalis
atgcgaaaaattttgagctttttgatgatgtgctctctgcatttaggtctacaatctcagacttggcatggagatccggactcagtggcagccctaccttctatcggtattcaagagtcaagttgtacccgaatcacgttcgaggttgttttccccggattttatagtgtggaaaaacgagaaggcaaccaagtctttcagcgcatttccatgccgggttgtggctcgtttgggaatctgggcgaagctgaattgcctgttttgaaaaagatgatagccgttccggaattttcaacagctaacgttgctgtaaaaatcaaagagacggagacattcgacaattataatatctatcctaatcctacctatgtcgtagaggagttgcctgagggggggacttatctggtagaggctttcgcgataaacaatgactattatagccaaaatgtaagcctcccttctactcactatgtctattctcaagacgggtattttcgctcacaaagatttatcgaagttaccctgtatccttttcgatacaaccctgtccgacaagaaattctatttgcaaaaaaaatcgaggttacaataactttcgataatcctcagccacctttacaaaaaaacaccggcatatttaacaaagtagcctcctctgcatttattaattatgaagctgatggcaaatcggcgatagaaaatgatatggtgttcagtcgtggtacaacaacgtacataagcggaaatgttgccagcaacctccctcagaactgtgactacttggttatttacgatgatatgttcaacgtaaatcaacaaccacacgacgaaatcaaacggctgtgcgaacatagagccttctacaacggctttgatgtagctgctgtaagtataaaggacgtattgaatagcttcccatcaaatgccacctcatacatcaacgaaactaaactgaaaaatttcattcgctcagtttacaaccaaagcaatgcgaagaggactttagatggcaaactgggatacgtgctactgatcggaaaaccattgagcaaatatttggctgacactgataatacaaaagtcccaacctcttttattcataatgtctccttaattccaagtcatccaacttttggttccatatgcgcctccgactatttttttagttgtgtttcgccccttgatactgtcggcgatttgtttatcggtcgatttagcgtcaccaatgctcatgaattgcacaatctgattgaaaagactatcaacaaagaaatctcatataatcctattgcacacaaaaatattctttacgcagaagggaaaggctgcgatgctccaatcttacgtttattcttaaaagaaatcgcctctggttacacagtcaactctatcttaaaatctaatcaggtctctgcaatagactcgatatttgactgcttgaataatggttcccatcatttttattttaacactcatggaatgccgactgtttgggggatagggcagggactcgacgtcaatactctaacagcccgattgaacaatacatcttcgcagggattatgtacgagtctatcatgtagttcggctgtagcagattcaactattagatcgcttggagaagtcctgaccacatacgcacctaacaagggattctcggctttcttaggaggaagcagagccacccaatatgccgtttatttagaaggcccctgtcctccgtcagaattttatgaatatttaccttattctttatatcacaatctctcgactgttgttggcgaaatgttgctatcatccattatcaatactaattctgttgatacgtattcgaaattcaacttcaatttgcttggcgaccctgcactaaacattatggctcatggcatggaggttagtaattgtattacactaccaaacaacaccattataagcagtccgataacaataaaaaatggtggctgcctaaaaataccggaaaaaggagttttgcattttactaataatggctccatacaagtcatgtccggaggaactctggaaataggcaatcaggctaaaatatccggagagaccggtgctaaccccacctttattaccgtttacggcgatggtcttgcgattaacaagcaggtagagatagacaatatagaccgacttaacttgttttctacgcattcggtcatgcccaaatttcattttgacagtgtgaaattcaacagtgccccgctgtatacaacgaactgtattgtggagataagcaattgcgaatttaccaatcgaagtgacattatttcaaagaattgtgacctaagcgttgaaaacagtatgtttagcagttcggggataacggtattcaagcctatggctacaagctccatcaccggattatctacaaaagcaaagattaccgacaatactttttttgcgacaggaaacttcgcctaccatatcacaaacacgccaggcttaacagcaacctccaatgctgccatcaagttagacaatattcctgagtattacatttccggtaataaaatagtcaattgcgatgaggctcttgtactaaataatagtggcaacagaacgaacagactccacaatatcacacggaatgtgataaaaaactgtaggattgggagcacgctttataattcctatggtatttacaaccgaaataagatcagtaacaatcatataggagtacgtctcctcaacaacagttgtttttatttcgataatgctcctgtaatcaatgaagaagataagcagacgtttatttctaataggacttggcagctctattcatcaaacggtacattccctctcaacttccattacaacagcttgcaggggggagatacagatacatggatttacaacgacacgtatacgaatcgctatattgacgtttcaaataatcactggggcaacaatgatttgtttgatccgaatcaggttttcaatacgccagacttgttcatttggatacctttttgggatggattgccaaatgggagatcgggcaatagctctgctgaagcagtagaattccaaacagcattggactgtattggcaatagcgattatctttcggcaaaagtggctctcaagatgatggttgaaacctacccggaatccgactttgcaatagctgctttgaaggaattgttcaggatagagaaaatgtcaggcaacgattacgaaggcttgaaagattatttcagatccaatccaaccatcatctcttcccagaacttgttcccgacagctgatttcctgtctgcgcgatgcgatattgtgtgtgaaaactatcagtctgccatcgattggtacgaaaatcgcttgaatagtgaaatctcctatcaggacagtgtttttgcagtcattgaccttggtgacatttattggaatatgcagttagactcactcagagggactggtatagatttgaacatactttcctgtgaacaaaggaaatcgctcgaaagccatcaaaatgtaaaaaattatttgttgtcaactcttcccgaatcaacaggtactctcctgcctccattagaatgcaacaaatcaagccttgataaatccaagataatctctatttcgcccaatccggcgaaagctgttgtaacaataatctactataccgataacccttcctgttctgtaataaaaatatatggaataaatggagcctcggctgatataaccgggttgcccaaacatctatccgaaggttattacagcatacagttcaatacatccaactttgatcccggtttctacctggtaacgctaaatgttgatcagaaaattatagatacggaaaaattacgaatcaaa

SEQ ID NO: 202 - DNA, 3822 bp, Porphyromonas gingivalis
atgatgtgctctctgcatttaggtctacaatctcagacttggcatggagatccggactcagtggcagccctaccttctatcggtattcaagagtcaagttgtacccgaatcacgttcgaggttgttttccccggattttatagtgtggaaaaacgagaaggcaaccaagtctttcagcgcatttccatgccgggttgtggctcgtttgggaatctgggcgaagctgaattgcctgttttgaaaaagatgatagccgttccggaattttcaacagctaacgttgctgtaaaaatcaaagagacggagacattcgacaattataatatctatcctaatcctacctatgtcgtagaggagttgcctgagggggggacttatctggtagaggctttcgcgataaacaatgactattatagccaaaatgtaagcctcccttctactcactatgtctattctcaagacgggtattttcgctcacaaagatttatcgaagttaccctgtatccttttcgatacaaccctgtccgacaagaaattctatttgcaaaaaaaatcgaggttacaataactttcgataatcctcagccacctttacaaaaaaacaccggcatatttaacaaagtagcctcctctgcatttattaattatgaagctgatggcaaatcggcgatagaaaatgatatggtgttcagtcgtggtacaacaacgtacataagcggaaatgttgccagcaacctccctcagaactgtgactacttggttatttacgatgatatgttcaacgtaaatcaacaaccacacgacgaaatcaaacggctgtgcgaacatagagccttctacaacggctttgatgtagctgctgtaagtataaaggacgtattgaatagcttcccatcaaatgccacctcatacatcaacgaaactaaactgaaaaatttcattcgctcagtttacaaccaaagcaatgcgaagaggactttagatggcaaactgggatacgtgctactgatcggaaaaccattgagcaaatatttggctgacactgataatacaaaagtcccaacctcttttattcataatgtctccttaattccaagtcatccaacttttggttccatatgcgcctccgactatttttttagttgtgtttcgccccttgatactgtcggcgatttgtttatcggtcgatttagcgtcaccaatgctcatgaattgcacaatctgattgaaaagactatcaacaaagaaatctcatataatcctattgcacacaaaaatattctttacgcagaagggaaaggctgcgatgctccaatcttacgtttattcttaaaagaaatcgcctctggttacacagtcaactctatcttaaaatctaatcaggtctctgcaatagactcgatatttgactgcttgaataatggttcccatcatttttattttaacactcatggaatgccgactgtttgggggatagggcagggactcgacgtcaatactctaacagcccgattgaacaatacatcttcgcagggattatgtacgagtctatcatgtagttcggctgtagcagattcaactattagatcgcttggagaagtcctgaccacatacgcacctaacaagggattctcggctttcttaggaggaagcagagccacccaatatgccgtttatttagaaggcccctgtcctccgtcagaattttatgaatatttaccttattctttatatcacaatctctcgactgttgttggcgaaatgttgctatcatccattatcaatactaattctgttgatacgtattcgaaattcaacttcaatttgcttggcgaccctgcactaaacattatggctcatggcatggaggttagtaattgtattacactaccaaacaacaccattataagcagtccgataacaataaaaaatggtggctgcctaaaaataccggaaaaaggagttttgcattttactaataatggctccatacaagtcatgtccggaggaactctggaaataggcaatcaggctaaaatatccggagagaccggtgctaaccccacctttattaccgtttacggcgatggtcttgcgattaacaagcaggtagagatagacaatatagaccgacttaacttgttttctacgcattcggtcatgcccaaatttcattttgacagtgtgaaattcaacagtgccccgctgtatacaacgaactgtattgtggagataagcaattgcgaatttaccaatcgaagtgacattatttcaaagaattgtgacctaagcgttgaaaacagtatgtttagcagttcggggataacggtattcaagcctatggctacaagctccatcaccggattatctacaaaagcaaagattaccgacaatactttttttgcgacaggaaacttcgcctaccatatcacaaacacgccaggcttaacagcaacctccaatgctgccatcaagttagacaatattcctgagtattacatttccggtaataaaatagtcaattgcgatgaggctcttgtactaaataatagtggcaacagaacgaacagactccacaatatcacacggaatgtgataaaaaactgtaggattgggagcacgctttataattcctatggtatttacaaccgaaataagatcagtaacaatcatataggagtacgtctcctcaacaacagttgtttttatttcgataatgctcctgtaatcaatgaagaagataagcagacgtttatttctaataggacttggcagctctattcatcaaacggtacattccctctcaacttccattacaacagcttgcaggggggagatacagatacatggatttacaacgacacgtatacgaatcgctatattgacgtttcaaataatcactggggcaacaatgatttgtttgatccgaatcaggttttcaatacgccagacttgttcatttggatacctttttgggatggattgccaaatgggagatcgggcaatagctctgctgaagcagtagaattccaaacagcattggactgtattggcaatagcgattatctttcggcaaaagtggctctcaagatgatggttgaaacctacccggaatccgactttgcaatagctgctttgaaggaattgttcaggatagagaaaatgtcaggcaacgattacgaaggcttgaaagattatttcagatccaatccaaccatcatctcttcccagaacttgttcccgacagctgatttcctgtctgcgcgatgcgatattgtgtgtgaaaactatcagtctgccatcgattggtacgaaaatcgcttgaatagtgaaatctcctatcaggacagtgtttttgcagtcattgaccttggtgacatttattggaatatgcagttagactcactcagagggactggtatagatttgaacatactttcctgtgaacaaaggaaatcgctcgaaagccatcaaaatgtaaaaaattatttgttgtcaactcttcccgaatcaacaggtactctcctgcctccattagaatgcaacaaatcaagccttgataaatccaagataatctctatttcgcccaatccggcgaaagctgttgtaacaataatctactataccgataacccttcctgttctgtaataaaaatatatggaataaatggagcctcggctgatataaccgggttgcccaaacatctatccgaaggttattacagcatacagttcaatacatccaactttgatcccggtttctacctggtaacgctaaatgttgatcagaaaattatagatacggaaaaattacgaatcaaa

SEQ ID NO: 203 - DNA, 2775 bp, Porphyromonas gingivalis
atggctatcatgatgaaaagtattgtttttagagcatttctaacgattttgctctcgtgggcagcgatcacgaatccgactgctcaagagatctcaggcatgaatgcatcctgtctggctgctccggctcaaccggatactatcttatatgaaagttttgagaatggacctgttcccaatggctggcttgagatagatgctgatgctgatggtgccacttggggaagcccatcaggctctttctctgtaccttacggacacaatggcctttgcacctactcccatatacgttccggtatctcaacagcgggcaactatctgattacacccaatatagaaggagccaaacgggtcaagtactgggtatgcaatcagtatagtaccaatccggaacattacgcagtaatggtatcgacaacggggactgccattgaagactttgttttgttgtttgatgattccataacagggaaaccgactcctcttgtatggcgtagacgaatcgtggacttaccggaagggaccaaatatattgcatggcgacattacaaagtcaccgactcacacacagaattcttgaaattggatgatgtcactgtgtataggtcgatcgaagggcccgaacctgctaccgacttcacagtaatcaatattggtcagaatgtgggacgattgacttggaactatccggaggattatcaaccggaaggaaaggggaatgaagagttgcagcttagcggctacaacatctatgcgaacggtacactactggcacaaataaaagatgtctccatactggagtatgtggacagcacttactctttgcgagacaatcccttgcaagtggagtactgcgttacagccgtttacgatgaaagcatagaatcttcgaccgtatgtggcacgctgcattacgccacggatgccatcctttatgaaaattttgagaatggacctgttcccaatggttggcttgtgatagacgctgatggagatggatttagctggggacactatttgaatgcatacgacgcttttcccggccataatggaggccattgctccttgtcggcttcttatgttccgggtataggcccggtgactcccgacaactatctgattacccccaaggttgaaggagccaaacgtgtcaagtactgggtaagcacgcaggatgccaattgggcagcggaacattacgcggtgatggcttcgacaacggggactgctgtcggagatttcgtcatattgttcgaagaaaccatgacagcgaagccgaccggcgcatggtatgaaagaaccatcaacttacctgaagggactaaatacatcgcatggcggcattacaactgtaccgatatatatttcttgaagttggacgatatcactgtattcgggactcctgcatcagagcccgaacctgttaccgatttcgttgtctcgcttattgaaaacaacaagggacgattaaagtggaattatcctaacggctacgaacccgataagactgatgataaagacccattgcagcttgccggctacaatatctatgcaaacggctcgctccttgttcacatacaagacccgactgttttggagtatatcgatgagacttattcttcacgagacgatcaggtggaagtggaatattgtgtcactgccgtttataacgacaatatcgagtcccaatcggtttgcgataagctgatttatgattctcaatcggacattatcttatatgaaggctttgaggccggaagtattcctgaaggctggttgttgattgatgctgatggcgacaatgttaattgggactattatccttggactatgtatggacatgacagtgagaagtgtattgcatccccttcgtacttaccgatgattggcgttttaactccggataactatttggttacacccagactcgaaggagccaagcttgtcaagtattgggtaagtgcgcaagatgctgtttattcggctgagcattatgctgtgatggtttctactacgggaactgctgttgaagattttgtcctcttgttcgaagagacaatgaccgctaaggctaacggtgcatggtatgagcgaactattacattgcctgcaggaacaaaatatattgcctggcggcattatgattgcaccgatatgtttttcttgctcttggatgacattacggtttatcgttctactgagactgttcccgagcctgttactgatttcgttgtctcgcttattgagaataacaagggtcgcctgaaatggaattatcctaacggctacgaacccgataagactgatgataaaaaaccattgcagcttaccggctacaacatctatgcaaatggctcgctccttgttcacatacaagacccgactgttttggagtatatcgatgagacttattcttcacgagacggtcaggtggaaatggaatattgtgtcactgccgtttataacgacaatatcgagtcccaatcggtttgcgataagctgaactatactatcacatccttggataatattcaatctgatacaagcttgaaaatatatcctaatccggcatcgtatgtggtaaggatagagggattgagtcggagcaagtcgacaatcgagttgtataatgcgctgggaatttgcatattaagggaagagactcattcagagaaaacggaaatcgatgtttcacgtctcaatgacggagtctacttgattaaagtagtcggtggaaataaaacaacaaccgaaaaggtagagataaagaggccg

SEQ ID NO: 204 - DNA, 2766 bp, Porphyromonas gingivalis
atgatgaaaagtattgtttttagagcatttctaacgattttgctctcgtgggcagcgatcacgaatccgactgctcaagagatctcaggcatgaatgcatcctgtctggctgctccggctcaaccggatactatcttatatgaaagttttgagaatggacctgttcccaatggctggcttgagatagatgctgatgctgatggtgccacttggggaagcccatcaggctctttctctgtaccttacggacacaatggcctttgcacctactcccatatacgttccggtatctcaacagcgggcaactatctgattacacccaatatagaaggagccaaacgggtcaagtactgggtatgcaatcagtatagtaccaatccggaacattacgcagtaatggtatcgacaacggggactgccattgaagactttgttttgttgtttgatgattccataacagggaaaccgactcctcttgtatggcgtagacgaatcgtggacttaccggaagggaccaaatatattgcatggcgacattacaaagtcaccgactcacacacagaattcttgaaattggatgatgtcactgtgtataggtcgatcgaagggcccgaacctgctaccgacttcacagtaatcaatattggtcagaatgtgggacgattgacttggaactatccggaggattatcaaccggaaggaaaggggaatgaagagttgcagcttagcggctacaacatctatgcgaacggtacactactggcacaaataaaagatgtctccatactggagtatgtggacagcacttactctttgcgagacaatcccttgcaagtggagtactgcgttacagccgtttacgatgaaagcatagaatcttcgaccgtatgtggcacgctgcattacgccacggatgccatcctttatgaaaattttgagaatggacctgttcccaatggttggcttgtgatagacgctgatggagatggatttagctggggacactatttgaatgcatacgacgcttttcccggccataatggaggccattgctccttgtcggcttcttatgttccgggtataggcccggtgactcccgacaactatctgattacccccaaggttgaaggagccaaacgtgtcaagtactgggtaagcacgcaggatgccaattgggcagcggaacattacgcggtgatggcttcgacaacggggactgctgtcggagatttcgtcatattgttcgaagaaaccatgacagcgaagccgaccggcgcatggtatgaaagaaccatcaacttacctgaagggactaaatacatcgcatggcggcattacaactgtaccgatatatatttcttgaagttggacgatatcactgtattcgggactcctgcatcagagcccgaacctgttaccgatttcgttgtctcgcttattgaaaacaacaagggacgattaaagtggaattatcctaacggctacgaacccgataagactgatgataaagacccattgcagcttgccggctacaatatctatgcaaacggctcgctccttgttcacatacaagacccgactgttttggagtatatcgatgagacttattcttcacgagacgatcaggtggaagtggaatattgtgtcactgccgtttataacgacaatatcgagtcccaatcggtttgcgataagctgatttatgattctcaatcggacattatcttatatgaaggctttgaggccggaagtattcctgaaggctggttgttgattgatgctgatggcgacaatgttaattgggactattatccttggactatgtatggacatgacagtgagaagtgtattgcatccccttcgtacttaccgatgattggcgttttaactccggataactatttggttacacccagactcgaaggagccaagcttgtcaagtattgggtaagtgcgcaagatgctgtttattcggctgagcattatgctgtgatggtttctactacgggaactgctgttgaagattttgtcctcttgttcgaagagacaatgaccgctaaggctaacggtgcatggtatgagcgaactattacattgcctgcaggaacaaaatatattgcctggcggcattatgattgcaccgatatgtttttcttgctcttggatgacattacggtttatcgttctactgagactgttcccgagcctgttactgatttcgttgtctcgcttattgagaataacaagggtcgcctgaaatggaattatcctaacggctacgaacccgataagactgatgataaaaaaccattgcagcttaccggctacaacatctatgcaaatggctcgctccttgttcacatacaagacccgactgttttggagtatatcgatgagacttattcttcacgagacggtcaggtggaaatggaatattgtgtcactgccgtttataacgacaatatcgagtcccaatcggtttgcgataagctgaactatactatcacatccttggataatattcaatctgatacaagcttgaaaatatatcctaatccggcatcgtatgtggtaaggatagagggattgagtcggagcaagtcgacaatcgagttgtataatgcgctgggaatttgcatattaagggaagagactcattcagagaaaacggaaatcgatgtttcacgtctcaatgacggagtctacttgattaaagtagtcggtggaaataaaacaacaaccgaaaaggtagagataaagaggccg

SEQ ID NO: 205 - DNA, 2763 bp, Porphyromonas gingivalis
atgaaaagtattgtttttagagcatttctaacgattttgctctcgtgggcagcgatcacgaatccgactgctcaagagatctcaggcatgaatgcatcctgtctggctgctccggctcaaccggatactatcttatatgaaagttttgagaatggacctgttcccaatggctggcttgagatagatgctgatgctgatggtgccacttggggaagcccatcaggctctttctctgtaccttacggacacaatggcctttgcacctactcccatatacgttccggtatctcaacagcgggcaactatctgattacacccaatatagaaggagccaaacgggtcaagtactgggtatgcaatcagtatagtaccaatccggaacattacgcagtaatggtatcgacaacggggactgccattgaagactttgttttgttgtttgatgattccataacagggaaaccgactcctcttgtatggcgtagacgaatcgtggacttaccggaagggaccaaatatattgcatggcgacattacaaagtcaccgactcacacacagaattcttgaaattggatgatgtcactgtgtataggtcgatcgaagggcccgaacctgctaccgacttcacagtaatcaatattggtcagaatgtgggacgattgacttggaactatccggaggattatcaaccggaaggaaaggggaatgaagagttgcagcttagcggctacaacatctatgcgaacggtacactactggcacaaataaaagatgtctccatactggagtatgtggacagcacttactctttgcgagacaatcccttgcaagtggagtactgcgttacagccgtttacgatgaaagcatagaatcttcgaccgtatgtggcacgctgcattacgccacggatgccatcctttatgaaaattttgagaatggacctgttcccaatggttggcttgtgatagacgctgatggagatggatttagctggggacactatttgaatgcatacgacgcttttcccggccataatggaggccattgctccttgtcggcttcttatgttccgggtataggcccggtgactcccgacaactatctgattacccccaaggttgaaggagccaaacgtgtcaagtactgggtaagcacgcaggatgccaattgggcagcggaacattacgcggtgatggcttcgacaacggggactgctgtcggagatttcgtcatattgttcgaagaaaccatgacagcgaagccgaccggcgcatggtatgaaagaaccatcaacttacctgaagggactaaatacatcgcatggcggcattacaactgtaccgatatatatttcttgaagttggacgatatcactgtattcgggactcctgcatcagagcccgaacctgttaccgatttcgttgtctcgcttattgaaaacaacaagggacgattaaagtggaattatcctaacggctacgaacccgataagactgatgataaagacccattgcagcttgccggctacaatatctatgcaaacggctcgctccttgttcacatacaagacccgactgttttggagtatatcgatgagacttattcttcacgagacgatcaggtggaagtggaatattgtgtcactgccgtttataacgacaatatcgagtcccaatcggtttgcgataagctgatttatgattctcaatcggacattatcttatatgaaggctttgaggccggaagtattcctgaaggctggttgttgattgatgctgatggcgacaatgttaattgggactattatccttggactatgtatggacatgacagtgagaagtgtattgcatccccttcgtacttaccgatgattggcgttttaactccggataactatttggttacacccagactcgaaggagccaagcttgtcaagtattgggtaagtgcgcaagatgctgtttattcggctgagcattatgctgtgatggtttctactacgggaactgctgttgaagattttgtcctcttgttcgaagagacaatgaccgctaaggctaacggtgcatggtatgagcgaactattacattgcctgcaggaacaaaatatattgcctggcggcattatgattgcaccgatatgtttttcttgctcttggatgacattacggtttatcgttctactgagactgttcccgagcctgttactgatttcgttgtctcgcttattgagaataacaagggtcgcctgaaatggaattatcctaacggctacgaacccgataagactgatgataaaaaaccattgcagcttaccggctacaacatctatgcaaatggctcgctccttgttcacatacaagacccgactgttttggagtatatcgatgagacttattcttcacgagacggtcaggtggaaatggaatattgtgtcactgccgtttataacgacaatatcgagtcccaatcggtttgcgataagctgaactatactatcacatccttggataatattcaatctgatacaagcttgaaaatatatcctaatccggcatcgtatgtggtaaggatagagggattgagtcggagcaagtcgacaatcgagttgtataatgcgctgggaatttgcatattaagggaagagactcattcagagaaaacggaaatcgatgtttcacgtctcaatgacggagtctacttgattaaagtagtcggtggaaataaaacaacaaccgaaaaggtagagataaagaggccg

SEQ ID NO: 206 - DNA, 1779 bp, Porphyromonas gingivalis
atgaacagcatcatgaaatatcaattatatacggccgtcataatggctctctctgtatcatccgtttgcggtcaaaccccacgaaatacagaaaccaaacgccccgacacgctgcgcagggagcttactatcgttaatgaccagactgtggagatggagcatgcggatccgcttccggctgcatacaaggccatcgaacctcgattaaaacctttccgtccggaatataacaagcgtacattcggatttgtccctgaagtttcctcttcaggcaggaacaatcttccgaatatcctgccgacggaaggtcatatgaagcaccgggggtacctgaatatcggtatcggccatacgctaaaccagcgaatggatgccggctatcgtctgatagatgcagagcaggagagactgaatcttttcctctcctatcgtgggatgaaatcggctttcaataccggtgacttcgacggcgacagaaaggatagacgaatgatggcaggagtggactacgagcagcgcaggccttcctttgtgcttgctaccggcttgtattattcgaaccattatttcaataactacggacggggagctaccaccaatgtgggcagcatccctcagctatcgacacctgttactcctcagatggacaacgggacccacaacgtccgtgtatacttgggtgcaaaaaatgatgtgatcgatgccaggatcgactatcgtttcttccgttctattccctatctgggtaccgatccgatgaaggctctcacagaacatacgcctgaactgaacgtgacgatgagtaatgagttgtccgatgatattaagctcggtgtcgaagttcgtacgggaggattgttttttgccaaaaacagcgaaatgattcaaacgggcgttctgtccgaaaccgaccgcaacctgtattatgtggagggcgcgcccacaatcggatttgtcggagactcggacaatatgcaatggaacatacaggccggagtagggatttcttcccatttcggagccaaagggaggttgtttttctggcctaaactggatgcttcgcttagtatcttcccttcatggcgtgtgtatgcgaaagccttcggcggtgtgattcgaaatggtctcgccgatgttatgcaagaggagatgccctacctgatgcccaatacgattgtactcccttcgcgcaatgctttgaccgcccaattaggggtgaaggggaatatagccgatgtggtacgtatggaggtttatggcgacttctccaagctgacaggtgtgcctttctatactccgactctacccttatataatccatccgacttgtatcagtataatgtgagtttcttgccgatatatgccgacggcagccgctggcgcgcaggtggtaagctggaatactcttatcgcgatatgctccgctttctggtagacgcatcctatggcaagtggaatttggatggaggacttgtcgcctccatgcagcccgatcttatattgaaggcagaagtaggtgttcatcccattgccccattggatgtcagactccggtatacacagctgaacggacggtatcggtattctttcggctcggctggctcggaagccttgggtatcggtaatgtacatcttcttagtgcggatgtttcatacaagctgaaaaagaacttgagcctttatctcaaaatcgataatatgctggcggaaacgacagagcttatcggttattatcctatgcagccgttccattgtttcgccggttttagctggactttc

SEQ ID NO: 207 - DNA, 1767 bp, Porphyromonas gingivalis
atgaaatatcaattatatacggccgtcataatggctctctctgtatcatccgtttgcggtcaaaccccacgaaatacagaaaccaaacgccccgacacgctgcgcagggagcttactatcgttaatgaccagactgtggagatggagcatgcggatccgcttccggctgcatacaaggccatcgaacctcgattaaaacctttccgtccggaatataacaagcgtacattcggatttgtccctgaagtttcctcttcaggcaggaacaatcttccgaatatcctgccgacggaaggtcatatgaagcaccgggggtacctgaatatcggtatcggccatacgctaaaccagcgaatggatgccggctatcgtctgatagatgcagagcaggagagactgaatcttttcctctcctatcgtgggatgaaatcggctttcaataccggtgacttcgacggcgacagaaaggatagacgaatgatggcaggagtggactacgagcagcgcaggccttcctttgtgcttgctaccggcttgtattattcgaaccattatttcaataactacggacggggagctaccaccaatgtgggcagcatccctcagctatcgacacctgttactcctcagatggacaacgggacccacaacgtccgtgtatacttgggtgcaaaaaatgatgtgatcgatgccaggatcgactatcgtttcttccgttctattccctatctgggtaccgatccgatgaaggctctcacagaacatacgcctgaactgaacgtgacgatgagtaatgagttgtccgatgatattaagctcggtgtcgaagttcgtacgggaggattgttttttgccaaaaacagcgaaatgattcaaacgggcgttctgtccgaaaccgaccgcaacctgtattatgtggagggcgcgcccacaatcggatttgtcggagactcggacaatatgcaatggaacatacaggccggagtagggatttcttcccatttcggagccaaagggaggttgtttttctggcctaaactggatgcttcgcttagtatcttcccttcatggcgtgtgtatgcgaaagccttcggcggtgtgattcgaaatggtctcgccgatgttatgcaagaggagatgccctacctgatgcccaatacgattgtactcccttcgcgcaatgctttgaccgcccaattaggggtgaaggggaatatagccgatgtggtacgtatggaggtttatggcgacttctccaagctgacaggtgtgcctttctatactccgactctacccttatataatccatccgacttgtatcagtataatgtgagtttcttgccgatatatgccgacggcagccgctggcgcgcaggtggtaagctggaatactcttatcgcgatatgctccgctttctggtagacgcatcctatggcaagtggaatttggatggaggacttgtcgcctccatgcagcccgatcttatattgaaggcagaagtaggtgttcatcccattgccccattggatgtcagactccggtatacacagctgaacggacggtatcggtattctttcggctcggctggctcggaagccttgggtatcggtaatgtacatcttcttagtgcggatgtttcatacaagctgaaaaagaacttgagcctttatctcaaaatcgataatatgctggcggaaacgacagagcttatcggttattatcctatgcagccgttccattgtttcgccggttttagctggactttc

SEQ ID NO: 208 - DNA, 1038 bp, Porphyromonas gingivalis
atgatggaaaaatgtatctttgctcactatccacataaccttgtgttcatgattcgcaagcatttcggtatcattttgggatttctttctcttgtgttttcggcaggtgctcaacaagagaagcaggtgtttcattttctgaaccttccggctactgcacaggctttggctgccggaggcaaagctatcaccatcgtagacgacaatcccggactggcttttgagaatccggctctgctcggatatgaatccggtggccgcgcctttctttcctatttatattatatgagtggttcgcatatgggcaatgcctgttatgcctcgtccgtcggagagcgtggcatgtggggtgttggcatgcgtttcctgaactacgggtctatgcaaggatacgatcagaatgcgattgccaccggctcttttagtgcttcggatatagctgtacaaggattttacagccatgaactgagcaaccacttccgcggtggagtcagcctaaaagcattgtattcttctatcgagacgtatagttcctttggccttggtgtggatgtcggtatcagttattacgacgatgacaaaggatattccgcttccgctctgttcaagaacgtaggggcgcaactgaaaggctataatgaagaacgggaaccgctcgattgggatttccagctcggcttttcccgcagttttatcaatgctccgtttcgcttgcacatcacgttgttcaatctgaatccgcactatttcaagcgtcttgtaccacgcgatctgtccaagatgcaaaagttcctccgacacttctcgataggagcagaatttactccttccgagaggttttgggtcgggctgggatatacgccacagattgcacaggatttcgaggtggaaggcggcaacaaatggggaggtctttcggccggcgtcggtttcacttcaggtgtagtacgtgtaggcgtatctgctgccacctatcatcctgcagctctttcgttcatgtgttcggtaggtatccgtttggacgataagagcatcttc

SEQ ID NO: 209 - DNA, 1035 bp, Porphyromonas gingivalis
atggaaaaatgtatctttgctcactatccacataaccttgtgttcatgattcgcaagcatttcggtatcattttgggatttctttctcttgtgttttcggcaggtgctcaacaagagaagcaggtgtttcattttctgaaccttccggctactgcacaggctttggctgccggaggcaaagctatcaccatcgtagacgacaatcccggactggcttttgagaatccggctctgctcggatatgaatccggtggccgcgcctttctttcctatttatattatatgagtggttcgcatatgggcaatgcctgttatgcctcgtccgtcggagagcgtggcatgtggggtgttggcatgcgtttcctgaactacgggtctatgcaaggatacgatcagaatgcgattgccaccggctcttttagtgcttcggatatagctgtacaaggattttacagccatgaactgagcaaccacttccgcggtggagtcagcctaaaagcattgtattcttctatcgagacgtatagttcctttggccttggtgtggatgtcggtatcagttattacgacgatgacaaaggatattccgcttccgctctgttcaagaacgtaggggcgcaactgaaaggctataatgaagaacgggaaccgctcgattgggatttccagctcggcttttcccgcagttttatcaatgctccgtttcgcttgcacatcacgttgttcaatctgaatccgcactatttcaagcgtcttgtaccacgcgatctgtccaagatgcaaaagttcctccgacacttctcgataggagcagaatttactccttccgagaggttttgggtcgggctgggatatacgccacagattgcacaggatttcgaggtggaaggcggcaacaaatggggaggtctttcggccggcgtcggtttcacttcaggtgtagtacgtgtaggcgtatctgctgccacctatcatcctgcagctctttcgttcatgtgttcggtaggtatccgtttggacgataagagcatcttc

SEQ ID NO: 210 - DNA, 990 bp, Porphyromonas gingivalis
atgattcgcaagcatttcggtatcattttgggatttctttctcttgtgttttcggcaggtgctcaacaagagaagcaggtgtttcattttctgaaccttccggctactgcacaggctttggctgccggaggcaaagctatcaccatcgtagacgacaatcccggactggcttttgagaatccggctctgctcggatatgaatccggtggccgcgcctttctttcctatttatattatatgagtggttcgcatatgggcaatgcctgttatgcctcgtccgtcggagagcgtggcatgtggggtgttggcatgcgtttcctgaactacgggtctatgcaaggatacgatcagaatgcgattgccaccggctcttttagtgcttcggatatagctgtacaaggattttacagccatgaactgagcaaccacttccgcggtggagtcagcctaaaagcattgtattcttctatcgagacgtatagttcctttggccttggtgtggatgtcggtatcagttattacgacgatgacaaaggatattccgcttccgctctgttcaagaacgtaggggcgcaactgaaaggctataatgaagaacgggaaccgctcgattgggatttccagctcggcttttcccgcagttttatcaatgctccgtttcgcttgcacatcacgttgttcaatctgaatccgcactatttcaagcgtcttgtaccacgcgatctgtccaagatgcaaaagttcctccgacacttctcgataggagcagaatttactccttccgagaggttttgggtcgggctgggatatacgccacagattgcacaggatttcgaggtggaaggcggcaacaaatggggaggtctttcggccggcgtcggtttcacttcaggtgtagtacgtgtaggcgtatctgctgccacctatcatcctgcagctctttcgttcatgtgttcggtaggtatccgtttggacgataagagcatcttc

SEQ ID NO: 211 - DNA, 972 bp, Porphyromonas gingivalis
atgtgcctcgaacccataattgctccgatttcatccgagttgctcgagcaggagctgactgccgatcgttttctgcggatgacaaacaaagccggcaatgagatctatgtttttacggccgaagaagctccgcattgcatgaaagaagtaggccgactgcgagaagaagcctttcggcattatggcggaggtactggcaaggcgatcgatatagacgagttcgacaccatgcccgggagctacaaacagctgatcgtatgggatccgcaaaacaaggctatactcggaggctaccgctttatctatgggcgggacgttgctttcgataccgatggcaagcctttgctggcaacggcagagatgtttcgcttcagtgatgcttttttgcacgattatctcccctacacagtcgaattgggacgttcgttcgtgtcgctccagtaccaatcgacacggatgggcacaaaggccatttttgtgctggacaatctttgggacggtatcggagcactcactgtagtcaatccagaggcactctatttctatggcaaggtgaccatgtacaaagactatgatcggcgagctcgcaatctgatcctgtattttcttcgcaagcacttctccgatccggaaggcttggtcaagcctattcatcccctaccgatagagatcagtgcggaggacgaagccttgttctcctcatccgactttgacaccaattacaagactctcaatatagaagtgcgcaagctgggtatcaatatccctcctctcgtgagtgcatatatagctttgtctccggagatgcgtgttttcggcactgcagtgaatgagtctttcggagaggtggaggaaaccggcatattcattgctgtgggtaagatcctggaagagaaaaaacaacggcacatagagagcttcatcctcagccggaacgaaaaaaaaggtctcgacagtagcaatggccgatca

SEQ ID NO: 212 - DNA, 1641 bp, Porphyromonas gingivalis
atgaaaaccattgtaagatacagccgccttccggtcgctctcttcttttgccttttgggagctgtgcacttgtctgtcgaggcgcagatgctcaatactcctttcgagctgtcggatcagatcgtcctgtctcccaccgaaaggcaatacagggagatttgtgtgcaaacgaaagaaaaaaggggggccgatcttttcccgttgagcgataagctgcgcgattcggcctatgttcgtttcggctcggcctatggcgatattgcgggcgactatcttccgtacaacggcaataactactcctcgctctcgctcgaatcgggtggtcgcatcagtgtccgtaactatggcacattgcagggcagtgcttcctactcacgtggcatgcacaaacgcatcggctggaatgctctgcgcaacgccgaagcctactatccctatttggtgtccgattcgaccggcggagactatcatttcgaagactatcggcttgccggctactattcttttcgcgccggccgcttgcccctcggtataggcttctcatacaggggcgaagttgcttatcggctgaccgatccgcgtacgaccaatacgaccggtgcattggagctttcttgtgctacctctttgacgctgcctcgagagaacaggctatcgctttcggctgcgtatctctatcatagacaacacctcacacagtacaactggcgtcccgggcagcaggacaaattcttcgtcagctacggtttcggtcaggtggatgtcagcaacagccctatctggttcggtatctccagaatgaactacgtcaacggatggaagcttagctcccgtctggatacccgtaggggcgatgccatcggtctcgactacagcggctacttcctcgataccgaagagaggtcgtccatcaatctctttgctttgctttacaatcgcctgcgactctatggtagctggcatctgtcggacttcgatttttcattttcagccgactatgctctgcgccaagggatagagcggatatacgaagactacaagccggatgataattatcatatctacgacctccgtatcttggccattcgccgctggtatatgctcaatgagttttctgcccaagcccaagcctcctaccgtattcgcacggatagaggttgtgccctgagagtgagtgccggtagtgatttctacggctatgatgagacgtatcgcaagcatggacatcataccatgagcggaatgctacgtccttttgccggtatagcctatgaccatgccggatccaaattggattttggactttcgctttcggctgcttatcgaatggtgctgacgcattcgtataagattcgtaccatccagaaagagcagctcgactatcagctggcctatttgccctatgcctatcgtaatagagaaggcgtggaggtgcgttcctctctgtacgtctcgattccgatgcagaatacccaccgcctgatgacagagctgcggttgtatggcgacctgatgaaaagaaaggacggtatagcctatggcaaaacgcccggtgtcatctcacatatcctgtccgatccgcaagccgaacgaacgtccggccataccatcggggctatctgcaatatctcctacctcttc

SEQ ID NO: 213 - DNA, 2250 bp, Porphyromonas gingivalis
atgaaaaaacttcacatgattgccgccttagccgtcctgcctttctgcctgacggcacaagcacccgtctccaacagcgagatagatagtcttagcaatgtgcagctccagaccgtacaggtcgtagctactcgcgccacggcgaaaacccctgtcgcttacaccaacgttcgcaaggccgaactttccaagtccaattatggtcgtgacatcccctatctgctgatgctgactccctccgtggtagccaccagcgatgccggtacgggtatcggatattccggctttcgcgtgcgtggcaccgatgccaatcgcatcaacataactaccaatggagtacccctcaacgactccgaatctcagtccgtcttttgggtgaatatgcccgacttcgcctcttccatcgaagaccttcaggtgcagcgaggtgtgggtacttccaccaatggtgccggagcttttggggcaagtgtcaatatgcgtacggataatttgggactggctccttatggccgtgtcgatttgagcggaggttcgttcggcacattccgccgatcggtcaaactcggtagcggacgcatcggtcgccattgggcagtggatgcccgcctgtccaaaatcggttcggacggctacgtggatagaggaagcgtggatctgaaatcctatttcgcacaggtgggctatttcggtagcaacacggctctcaggttcatcactttcggaggaaaagaagttacgggtatcgcatggaacggtctttccaaggaggatgaagccaaatatggccgccgatacaacagtgccggtcttatgtacgtggacgcgcaaggagtaccgcactactaccacaataccgacaattacgagcagcgtcactaccatgccatcatgacgcacagcttctctccttccgttatcctcaacctcacggcacactacacggccggatatggctatacggacgaatatcgtaccggacgtaaactaaaggaatatgcactgcagccctatgtggaaaacagtgtgaccgtgaagaaaacggatctcatccgtcagaagtatctggacaatgacttcggaggactcatcggttcgcttaactggcacaccggtgcatgggatttgcagttcggggcctcgggcaatatctataaaggagaccacttcggccgtatcacttacatcaaaaagtacaatcagcccttagctcccgacttcgaatattatcggaacagggcagacaaaagagaaggtgcagcctttgccaaagccaactggcagatcactccggaactgaacatgtatgccgacctccagtatcgtaccatcggctacacgataaacggcatcacggacgaatatgatgaggtacagggaagtatgcagcacatcgatttggacaagaccttccgcttcctcaatccgaaggccggtcttacctatagtttcgacgatgctcatactgcctatgcttctgttgcggtagcacaccgcgagcctaacagaaccaattacaccgaagccggaataggacagtatcctacgcctgagcgactgatcgactatgagctgggctaccgctatgcttcgcccctcttgtcggccggagtaggtctctattatatgcaatacaaggaccaactcgtgctggatggccgtttgagcgatgtgggacagatgctcacaagcaacgtccccgacagctaccgtatgggactggagctgactctcggttggcagatccttcctcgtttgctgcgttgggatgcttctttcactatgagtcgcaacaaaatcgaccgctacgtacaatatacatccgtatatgatgcggactacaactggctcgaactcaaggaggagaccctcgaaagcacggatatagcctactcgcccaatgtcattgccggcagcatgcttaccctctctcatgccggtttcgaaatggcttggacgagccgcttcgtcagcaagcaatatctggacaatacacagcgcagcgatcgcatgctttcctcctattgggtgaacgacctccgcctcggctatgtgctgccggttcacttcgttaagagagtggcactgggcgtacagctcaataatctcttcaacctcatgtatgcgtccaatgcctacatctacgatgccggttacgtacaggcatccggagaactaagtgcatatgccgatctgcgttattatcctcaggccggatttaatgcactgggtagtctgacaatcgatttc

SEQ ID NO: 214 - DNA, 1482 bp, Porphyromonas gingivalis
atgaaaagaaggtttctatcgctgttactgctgtacatactctcttccatcagcctttctgctcagcggtttccgatggtgcagggaatcgagttggataccgattcgcttttctctctgcccaagcgtccttggcgcgccatcggtaaaacgataggcgtcaatctggccgtatggggcttcgatcatttcatcatgaacgaggactttgcagacatcagttggcagactatcaagagcaatttccaaacaggctttggctgggacaatgacaagtttgtcaccaacctcttcgcacatccttatcacggatcgctctatttcaatgcagcgaggtcgaacggtttgagcttcaggcactctgctccgtttgccttctttggcagtctcatgtgggagctgcttatggaaaacgagccaccgagtatcaacgacctctgtgccaccaccataggcggtatagctttgggggagatggggcacaggctgtcggacctgctcatcgacaatcgtaccacagggtgggaacgtatggggcgcgaggtggctatcgctctgatcaatccgatgcgctttctcaaccgtctgacagcaggagaggtgacttctgtcgggagtcgcagcggacagatatttcagtctgtccccataaacatagtcgtcgatgccggctttcgctttttggcagacaagcggcatgcccgaaccggtgccacggctctgaccctgaatctgagattcgactacggcgatccattccgaagcgagactttctctccatacgatttcttccaattcaaagccggattgagtttctccgaatcgcaacctctgctgagccagatcaatctgatcggaatcctaagcggatgccaactgctcgcacacgaacgaacggttttggtgggaggtctctttcagcacttcgactactacaattcggaaaaacgaataagcaaaaattcggaggaggtactcgtcaccccataccgtatctcgcaagtggcagctctgggaggcggtcttatcttccagcaccacggaaaatttcgacgacgtcctctggagctatatgccgagacctacctgaatgtcgtcccgatgggagccagtctgtcggatcactacaacgtggacaatcgggactataacctcggcagcggattgagcggcaagctataccttggtgctacgtacaatgatctgtggagctggctcttgggagtcgaaagctatcggctctacacatggatcgggtatgaagagccgcaccagaaaaataccgatgtcagctcttttatggtgcagggggacgaaagcaaggcgcgcctactggtgacgagttccgagttcgcatttcatcctggcccctggcatgtagccatcgtcgctcgccgtttcatccgcaaaacagcctatcaattctaccctaacgtatcattcgataccggcgacatacagctgcgtgtcggatttcacttc

SEQ ID NO: 215 - DNA, 882 bp, Porphyromonas gingivalis
atgaaacgactgattgtttttctggcaatgggtggcttgctgttcacccttgcgaacgcacaagaagcaaacactgcatctgacactcccaaaaaggactggactataaaaggtgtgaccggactaaatgcctctcagacttctctgaccaactgggctgccggtggagaaaacacggtggcaggtaacctctatttgaacatagatgccaactacctgaaagataaatggagttgggacaacggtttgcgtacagacttcggtctgacctacacaacagccaacaagtggaacaaaagtgtagacaagatcgaactcttcacgaaggccggctatgagatcggcaaacattggtacggaagtgcgcttttcactttcctctcacagtatgccaaaggatatgagaagccctcggatcacttgacaggagtcaagcatatctctaatttcttcgctcctgcatatctcactctcggtattggtgcggactataagcccaatgagaagttctctctctacctctctcctacaacgggcaagctgactgtagtagcagacgactacctctcaagtttgggagccttcggggtgaaagttggtgaaaagacaatgttcgaacttggtgctttggtagtgggttcggccaatataaatctgatggagaatgtcaatttgataaccaaggcttcattcttctcggcttatacgcacgactttggcaacattgacatcaattgggaggctatgctggccatgaagatcaacaagttcctcacggctacgatagccaccaatcttatctacgacgatgatgtgaagatcaacgatggcccgaaaatccagttcaaagaagttgtgggcgtgggtgttgcgtacactttc

SEQ ID NO: 216 - DNA, 612 bp, Porphyromonas gingivalis
atgaagaaaatgattttggcagctactatgctgctcgcaacaatcggttttgcaaatgctcagagtcgtcctgctcttagactggatgctaactttgtcggtagtaacttaatgcaaaaagtcgcaaacacgagcgtgaacaataagatgatcgtaggcttacgtgttggtgctgctgctgagttcgctcttagcaatgatggattctatctcgcccccggattggcctatacgatgagaggtgctaagatggaatcactaagtgaaacgacaactcgcttgcattatctgcaaataccggtgaatgccggtatgagatttagctttgctgacaacatggctatttcattggaagcaggtccctatttcgcatatggtgtcgccggaacgattaagactaaagttgcaggcgttacggcttctgtagatgcctttggtgataacggatataaccgtttcgacttgggcttgggcttgtctgctgccttgagctacgaccgttattacgtacaaattggatatgagcatggattgcttaatatgttgaaggatgctccggataagacttctttgcgtaatcatgacttctttgtgggtctcggtgttcgcttc

SEQ ID NO: 217 - DNA, 729 bp, Porphyromonas gingivalis
atgaaaaggatttttactgtagcccttgtgctacttgcttcggtcactatggccatcggacaaagccgcccggcacttcgcgtagatgccaacttcgtaggcagcaatcagagcatgaaaagagacggatatgtgtgggacaccaaaatgaatgtcggcctgcgggtcggtgccgctgccgaattcatgatcggatcaagaggattctacttggctccgggtctgaactatacgatgaagggctccaaaaccgaatgggatatacccgaaatggttcctggtacctatattacgatggtttccactcgcttgcactatctgcaactgccgatcaatgccggcatgcggttcgacctgatgaatgacatggcggtttcgatcgaagcgggtcctttccttgcatacggtatatatggtacatatcggcagaagttggaaggatggaagccgaacaactacagcacagagttttttggcccaacgcttggtggcccaacaaatatccgctgggacatcggggcaaacataatagccgcattccactataagcgttattatatacagataggctatgaacatggatttgtggatattgtgtcaggtggaggttctgatattccccgactgaacgacaataggcaatcctcttcgacgaccgctctaagagaaaagggaaataacgaatacgcttataatcgtgacttcttcgtgggcataggttaccgcttt

SEQ ID NO: 218 - DNA, 621 bp, Porphyromonas gingivalis
atgaaaagaatgctgctgcttctcgttgtattattatatggaattgcaggccgattggctgcacaagacgttatcagaccatggtcattgcaggtcggagcgggatactccgatacggagaacatcccgggaggattcacctatggtttctatttgggaaagcgtatggggagctttctggaagtggggctgtccatgtacaactccacacgtcaaacagccaacaatgcagactcctttgcatcgaacgaaggagacggatcttttcaggtaaatatgtcttctccgaatgagaagtggtcattcttcgatgcaggcagtgccaactgctatatgatcgtcgtcggagtcaatcctctccatctgttttggcagaatagccggcacaatttgtttctggcagtacaagccggcctgtccaataagcacaatattcatttcatctatggagacaagggagccaaagtcagtatctacaccaattcgaatacctacatcggttacggagcacgtgtagcctacgaatatcaaattcataaaaacgtgggggcgggtgccgctgtaatgtacgaccacggcaataagatgcttacggccatggccacgctctccactcatttt

SEQ ID NO: 219 - DNA, 2853 bp, Porphyromonas gingivalis
atgagagtatccgatctctgttccagactttcatggttattacccgtaatccttgtcggattgctctgtgctactttggtcgctgcggaacgtcctatggccggagcagtcggattgcaccaccgtcggcatgctgcgctgtctgattctacagcgaaagacacggtgcctctcgcaaaacctattcctgacagtgcttttcgagattcccttcctgccgattccaccggatcgatgcggcaagatagcgtgtatgacgatgaattcgaattggaagatatagtggagtacgaagctgccgattccatcgttttgctcggacagaatcgtgcctatcttttcggcaagagctatgtgagctatcaaaagagtcgcttggaggcaaacttcatgtatctcaataccgacagcagtacggtttatactcgctatgtcctcgatacggccggttatccgatggcctttcctgttttcaaggatggagagcagtcgttcgaagccaagaactttacctacaacttccgcacggagaaggggattatcagcggagtgatcacgcagcagggcgaaggctatctgactgccggtaagaccaagaagatgcccgacaatatcatgtttatgcaaggagggcgttatacgacctgcgacaatcacgatcatcctcacttctatatcaatctttccaaggcaaaggtgcatccggagaaagacatcgtcacaggtccggtcaatctggttatcgccgatatgccgctgccgataggtcttcctttcggctattttcccttttccaacaaatactcttccggtatattgatgcccacgtacggagaggacaatcgctatggattttatttgaggaatggtggatattattttgccttcagcgactatatcgatttggcattgcgtggggagatcttttccaaagggtcatggggcatttcagcccaatcgaaatataagaagaggtataagtacaacggctcgttcgaagccaattatctggtatcgaagtccggcgacaaatacgtgcccggagactacagcaagaccaccagtctgaatatccgatggacacacagtcaggatccgaaggccaatcctttgcaaacgttgtcggccaatgtcaattttgccaccgggagctatttccagaattcgctgaataccacctatgatgtcaatgcccgtactgctacgacacgaagttcggccgtgagctattcgcgcaagtttccgggtactcctttttcgattacgggtagcatggatatcagccagaacatgcgcgatacgacggtgagccttaccttgccgaatctttcgattaatatgtccacgcgttatcctttcaagcggaagacccgtgtaggaccggagcgatggtacgagaagttgagtgtgggctattccggtcagcttcgcaatagtatcttgacaaaagagaaagatttgctccagagcaatctcgtgcgcgattggaagaatggtatgcgtcattccgtaccgatcagtttgactgtccctttgttggattatatcaatctgactatgggggttaactacaatgagtggtggtacacgaaaggcatacggaagtcgtggaatgaggataagaaaacattcctgccttcggacacgacctataaattccgcagactgtacgattacagtctgtcggcaggcttatctaccacattgtacggtatgttcaagccttggaaacctttttccttcggaggcaatctcattatgatccgtcatcgcttcacgcccactgtcagtttctcctatatgccggacttcacgaaacgccgatatggcttttgggagcttcttgagcatacggatcagaacggcaagctgcatacgctgctctactctccttatttcgagcagatattcggtgctccctccatgggcaatgcaggatctgtcaatttctcttttgacaacaacttagaggccaagatcaaatccaaatcggattcgacagggatcaagaagatcagcctgatagatcagttcacatggtctacatcctataatatgtttgccgattcgatccgatggagcaatatctcggcttcgctggcacttcgcctctccaagagctttaccttgcgcttgtccggtctgttcgatccctatttgacgaagtattatgagggagaagatgggaagatcattccctataagagcaacgacctgcgcatttttaacggcaagggattggcacgcctgatcagtacgggtacttctttcagctatacgctcaacaaagagtcgctcagcggattgatagctcttttcagtggcaaaaaggagcggagagatgaaaagaaaaacacaggggctactcctcatgaaggagacgatgctgccgatatacttgagggaggaagaccgcaaaatgaaagtggggggtcgctcctcgagcgcaaccgtcagggcggagcagtggatcaggatggttacttcgcatattcgatcccatggagcctgtccttcgactatagttggaatattgctaccgactacaataggtacaatgtcaataagatggagcactactaccgggtaacgcagaatctgagctttcgcggcaatatccagcctacaccgaactggagcttcggattcaatgcgaactacaatttcgacttgaagaaaataacatcgcttacctgcaacgtcactcgcgacatgcactgctgggctatctcggccagtttcatccctataggagcatacaagtcctataatttcgtcatatcggtgaagagttcactcttgcaggatctgaagtatcagcagagcaatcgtcccatcacgaatacttggtat

SEQ ID NO: 220 - DNA, 3678 bp, Porphyromonas gingivalis
  modified_base (2949)..(2949): n is a, c, g, or t
atgatgaaacgatatacaataattcttgcagtttttcttttattctgcacggtatttacctttcaaataaaagctcgcccttatgaaagatttgcagatgtagagaagccttggattcagaaacattcaatggattctaaattggtgcctgcaaataagggtaacttaattcaagctgaaattgtataccaatctgtttctgaacatagtgacttagttatttcacctgtgaacgaaataaggcctgcaaatcgtttcccttcgcataggaagtctttttttgcagaaaatctacgggcatctccccccgtagttcccgttgccgtcgacaagtatgcggtaccggttgccaatccaatggatcctgaaaatcccaatgcctgggatgtgacgctaaaaatcactactaaagcggtaacagtacctgtcgatgtggtgatggttatcgaccagtcttcgtcaatgggagggcaaaacattgccagattaaagtctgccattgcatcgggacagcgttttgtgaaaaaaatgttgcctaaggggacggctacagaaggggtgcgtatcgctcttgtgagttatgaccatgagcctcatcgcttatctgattttaccaaagacactgcttttctctgtcaaaaaatccgggctttgactcctatttggggaacacatacccagggggggcttaaaatggcgagaaacattatggccacttctactgctgtggataagcatatcatattgatgtctgacgggttagcgacggagcagtatcctgttaaaaatgtaactactgcagacttcattggcaaaactggaaatgcgaatgatcccattgatttggttatacaaggagcaattaatttccctacaaattatgtttccaacaatccatctacacctcttaccccaaattatccaactcattcttctaaagttggacggagaaatctgccggaatccaaattcgattatagtaatctgagtgcaaggattacttttgatggtgttgctggcgcattggtctatgaaccgaggtttcctcatccctattattattatttcccttgtaacgctgctatcaatgaggctcagtttgcgaaaaactctggttatacaatccatactattggctatgacctgggagattttgccttggccaacaattcgttgaaactaaccgctacagacgagaatcacttctttacggcgacaccggccaatttagctgcagcgtttgataatattgcccaaactattaatataggtatacagaggggggaggtgacggactttgtagctcctggtttcatcgttaaaaatctgacgcaatcgggagatgttactcatttgctaaatgtttcaaatggaacggtgcactatgatgtctctactaaaaaactgacatggactactggtactatcctgagctcatcagaagctaccataacttatcgtatttatgccgatttggattatatacagaacaatgatattccggtaaatactacttctgctatcggcccggatcttggtggattcgataccaataccgaggcaaaattgacctataccaattccaatggcgaaccgaatcagcagttaattttcccacgtccgacggttaagttaggttatggtgttattaagcggcactatgtattggtaaataaagacggtcaacccatacaggcaaatggaacagttgtcagttccctaagcgaggctcatgttctacagtcacaagatttctttttgccctcaggtggaggtcatattgttcccaaatggataaagttggacaaaacgaccgaagcattacagtactattccgtaccgccgactaacacggtcatcactactgccgatggtaaacgttatcgttttgtcgaagtcccaggctccacgccgaatccgggccaaatcggtatcagttggaaaaaaccggcaggaaacgcttacttcgcttacaagctcctcaattattggatgggaggaacaacagaccaacagagtgaatgggatgtgacgtccaattggacaggagcccaagtaccgctcacaggagaagatgtagagtttgcaacgacagaaaatttcggttctccggcggtagccgatttgcatgtcccgacaaccaaccccaaaattatcggtaaccttatcaataattccgacaaggatttagttgttaccacaagcagtcaattgacgatcaacggcgtggttgaggataacaatccgaatgtcggtacgatcgtcgtgaagtcgtcgaaagacaatcctacggggacattgctttttgccaatccgggctataatcaaaatgtaggggggaccgtcgagttttacaatcagggatatgattgtgccgattgtggtatgtatcgcaggagctggcagtatttcggtatccctgtcaatgaatcaggttttccaattaatgatgtgggcggaaacgagaccgtcaaccaatgggttgagcctttcaatggcgataagtggcggccagcaccttatgcacctgatacagagcttcaaaaattcaagggctaccagatcacgaatgacgtgcaggcacagcctacgggagtttacagcttcaagggtatgatttgtgtgtgcgatgccttcctgaatctgacacgcacgtccggtgtcaactactcgggcgccaacttgatcggcaactcatacactggagccatcgacatcaagcagggtattgtcttcccgccggaagtcgagcagacggtgtatctgttcaacacgggaacacgcgaccagtggcgtaagcttaatggaagcacggtttcaggctatcgagccggtcagtacctctctgtacctaagaatacagcgggtcaggacaatcttccggatcgtattccatcgatgcattccttcttggtgaagatgcagaacggagcgtcttgtacgttgcanatcttgtacgataagctgctcaagaacacgactgtaaacaacggtaatggtacgcagatcacatggcgatccggcaactccggatcggcgaatatgccgtcacttgtgatggatgttcttggtaacgagtcggccgaccgtttgtggatctttaccgatgggggtctttctttcggattcgacaacggctgggatggtcgcaagctgactgaaaaaggtttgtcacaactttatgcgatgtctgacatcggtaatgataaattccaggttgcaggggttccggagttgaataacctgctgatcggcttcgatgcggataaggatggtcaatacacgttggagtttgctctttcggatcattttgcgaaaggggctgtttacctgcacgatcttcagtcaggagccaaacaccgtattacgaattctacgtcgtattcattcgatgccaagcggggagattccggggctcgtttccgcttgtcatatggatgtgatgagaacgtagatgattcgcatgtcgtgagtacaaatggccgtgaaattataattctgaatcaagatgctcttgactgcactgtaaccttattcacaatagaaggtaagcttcttcgccgcttgaaagtattagctggtcatagagaagtcatgaaagtgcagaccggaggggcctatattgtgcatcttcaaaatgctttcactaatgatgtgcataaggtgcttgttgagtat

SEQ ID NO: 221 - DNA, 3675 bp, Porphyromonas gingivalis
  modified_base (2946)..(2946): n is a, c, g, or t
atgaaacgatatacaataattcttgcagtttttcttttattctgcacggtatttacctttcaaataaaagctcgcccttatgaaagatttgcagatgtagagaagccttggattcagaaacattcaatggattctaaattggtgcctgcaaataagggtaacttaattcaagctgaaattgtataccaatctgtttctgaacatagtgacttagttatttcacctgtgaacgaaataaggcctgcaaatcgtttcccttcgcataggaagtctttttttgcagaaaatctacgggcatctccccccgtagttcccgttgccgtcgacaagtatgcggtaccggttgccaatccaatggatcctgaaaatcccaatgcctgggatgtgacgctaaaaatcactactaaagcggtaacagtacctgtcgatgtggtgatggttatcgaccagtcttcgtcaatgggagggcaaaacattgccagattaaagtctgccattgcatcgggacagcgttttgtgaaaaaaatgttgcctaaggggacggctacagaaggggtgcgtatcgctcttgtgagttatgaccatgagcctcatcgcttatctgattttaccaaagacactgcttttctctgtcaaaaaatccgggctttgactcctatttggggaacacatacccagggggggcttaaaatggcgagaaacattatggccacttctactgctgtggataagcatatcatattgatgtctgacgggttagcgacggagcagtatcctgttaaaaatgtaactactgcagacttcattggcaaaactggaaatgcgaatgatcccattgatttggttatacaaggagcaattaatttccctacaaattatgtttccaacaatccatctacacctcttaccccaaattatccaactcattcttctaaagttggacggagaaatctgccggaatccaaattcgattatagtaatctgagtgcaaggattacttttgatggtgttgctggcgcattggtctatgaaccgaggtttcctcatccctattattattatttcccttgtaacgctgctatcaatgaggctcagtttgcgaaaaactctggttatacaatccatactattggctatgacctgggagattttgccttggccaacaattcgttgaaactaaccgctacagacgagaatcacttctttacggcgacaccggccaatttagctgcagcgtttgataatattgcccaaactattaatataggtatacagaggggggaggtgacggactttgtagctcctggtttcatcgttaaaaatctgacgcaatcgggagatgttactcatttgctaaatgtttcaaatggaacggtgcactatgatgtctctactaaaaaactgacatggactactggtactatcctgagctcatcagaagctaccataacttatcgtatttatgccgatttggattatatacagaacaatgatattccggtaaatactacttctgctatcggcccggatcttggtggattcgataccaataccgaggcaaaattgacctataccaattccaatggcgaaccgaatcagcagttaattttcccacgtccgacggttaagttaggttatggtgttattaagcggcactatgtattggtaaataaagacggtcaacccatacaggcaaatggaacagttgtcagttccctaagcgaggctcatgttctacagtcacaagatttctttttgccctcaggtggaggtcatattgttcccaaatggataaagttggacaaaacgaccgaagcattacagtactattccgtaccgccgactaacacggtcatcactactgccgatggtaaacgttatcgttttgtcgaagtcccaggctccacgccgaatccgggccaaatcggtatcagttggaaaaaaccggcaggaaacgcttacttcgcttacaagctcctcaattattggatgggaggaacaacagaccaacagagtgaatgggatgtgacgtccaattggacaggagcccaagtaccgctcacaggagaagatgtagagtttgcaacgacagaaaatttcggttctccggcggtagccgatttgcatgtcccgacaaccaaccccaaaattatcggtaaccttatcaataattccgacaaggatttagttgttaccacaagcagtcaattgacgatcaacggcgtggttgaggataacaatccgaatgtcggtacgatcgtcgtgaagtcgtcgaaagacaatcctacggggacattgctttttgccaatccgggctataatcaaaatgtaggggggaccgtcgagttttacaatcagggatatgattgtgccgattgtggtatgtatcgcaggagctggcagtatttcggtatccctgtcaatgaatcaggttttccaattaatgatgtgggcggaaacgagaccgtcaaccaatgggttgagcctttcaatggcgataagtggcggccagcaccttatgcacctgatacagagcttcaaaaattcaagggctaccagatcacgaatgacgtgcaggcacagcctacgggagtttacagcttcaagggtatgatttgtgtgtgcgatgccttcctgaatctgacacgcacgtccggtgtcaactactcgggcgccaacttgatcggcaactcatacactggagccatcgacatcaagcagggtattgtcttcccgccggaagtcgagcagacggtgtatctgttcaacacgggaacacgcgaccagtggcgtaagcttaatggaagcacggtttcaggctatcgagccggtcagtacctctctgtacctaagaatacagcgggtcaggacaatcttccggatcgtattccatcgatgcattccttcttggtgaagatgcagaacggagcgtcttgtacgttgcanatcttgtacgataagctgctcaagaacacgactgtaaacaacggtaatggtacgcagatcacatggcgatccggcaactccggatcggcgaatatgccgtcacttgtgatggatgttcttggtaacgagtcggccgaccgtttgtggatctttaccgatgggggtctttctttcggattcgacaacggctgggatggtcgcaagctgactgaaaaaggtttgtcacaactttatgcgatgtctgacatcggtaatgataaattccaggttgcaggggttccggagttgaataacctgctgatcggcttcgatgcggataaggatggtcaatacacgttggagtttgctctttcggatcattttgcgaaaggggctgtttacctgcacgatcttcagtcaggagccaaacaccgtattacgaattctacgtcgtattcattcgatgccaagcggggagattccggggctcgtttccgcttgtcatatggatgtgatgagaacgtagatgattcgcatgtcgtgagtacaaatggccgtgaaattataattctgaatcaagatgctcttgactgcactgtaaccttattcacaatagaaggtaagcttcttcgccgcttgaaagtattagctggtcatagagaagtcatgaaagtgcagaccggaggggcctatattgtgcatcttcaaaatgctttcactaatgatgtgcataaggtgcttgttgagtat

SEQ ID NO: 222 - DNA, 1275 bp, Porphyromonas gingivalis
atggaagtgaagaaaaacacagtggtgctacgccttctgatttggttcgtggccattcttctcttccactcctcacggctgtggggacaggaaggggaggggagtgcccgatacagattcaaaggattcgtggatacctaccatgccgtacgcagctcttctccttttgatttcatgagctcgcgtacgagagtgagaggtgagctggagaggtcgttcggtaattcgaaagtagccgtatcggtcaatgccacctacaatgctctactgaaagacgagaccggcttacgtttacgtgaagccttcttcgagcatcaggaagagcattgggggttgcgcctcggacgacagattgtcatttggggggctgccgacggtgtgcgcatcacggatctgatctccccgatggatatgaccgagtttctggcacaggattacgatgatattcgtatgccggtcaatgcattgcgtttctctgtcttcaacgaatcgatgaaagtggaagtcgtggtactgcctgtattcgaggggtaccgtctgcctgtggatcctcgcaatccttggaatatcttctccctttcgcccattgctcaggggatgaatatcgtctggaaagaagaagccggcaaaccggccttcaaggttgccaatatcgagtacggtgcgcgatggagcactacgctctccggtatcgacttcgctttggctgcattgcatacatggaacaagatgcccgtcatcgaagtacagggcattgtgccgacggaaatcatcgttagccctcgctattatcgtatgggatttgtcggcggcgacctctccgtacccgtcggacagtttgttttcaggggagaggctgcgttcaatatcgacaaacacttcacctataagagtcatgccgagcaagagggtttccaaacaatcaattggttggccggagccgattggtatgctcccggtgaatggatgatctcaggacaattctcaatggaaagcatattcaggtatagggatttcatctcccaaagacaacattctaccctgattactctcaatgtttccaagaaattcttcggcagtacactccaactttcggacttcacctactacgaccttacgggcaaaggatggttcagtcgctttgcagctgactatgccttgaacgatcagatacatctgatggccggatatgactggttcagtagtaagggcagcggtatattcgatcgctacaaagacaattccgaactctggttcaaagcccgctacagcttc

SEQ ID NO: 223 - DNA, 1212 bp, Porphyromonas gingivalis
atgtcctcctgtgaggtggcttatttttcactaaagccgatcgatctgcagaacatccgcgaacggaatcactcttccgacatcgcgctttccaatttattagacaattcgaatcagctattagctactattctgatcgggaataatgtgattaatgtagccatcgttatcctttccaattatgccatcgagcagacattcgttttctcttctccgatcattggatttctgatccagacgatactcctgaccactgttcttttgctgttcggagagattctgccgaaagtgtatgcgcggaagaatccgctgcaatactcgcgcttttctgctgcagctatgtccgttatctataagatattgtcaccgttttcaaaattgctggtcaaaagtaccggcatcgttaccagaggtatcagcaagaagaaatacgatatgtccgtggatgagctctcgaaagcggtagccctcaccactacggagggagagccggaggagaaagaaatgattaacgaaatcatcaaattctataataagacagcctgcgaaatcatggttccgcgtatcgatattgtggatgtggatctgagctggccatttcgtaagatgcttgacttcgttgtttcgtcgggttattccagacttcccgtttcagaggggtcagaagacaatatcaaaggggtgatttacatcaaagatctaatcccacacatggataaaggcgatgaattcgactggcatcctctgattcgtaaagcatattttgtccccgaaaacaagcgcatagatgatttgctcgaggagttcagagccaataaggtgcatgtctccatcgttgtggatgagttcggtggcacttgcggactgatcacaatggaggacatattggaagagatcgtcggcgagattacggacgagtacgatgaggaagaactcccctttaaggttttgggggatggcagttatcttttcgaaggaaaaacgtctctctccgatgttcgacactatcttgaccttccggaaaatgctttcggtgaattgggggacgaggtagatacgctaagtgggctcttcttggaaatcaagcaggaactcccccatgtgggcgatacagcagtgtacgagccattccgctttcaagtgacccaaatggacaagcgccgaatcatcgaaatcaagattttccctttcgagcgcacttgggaggtcgaa

SEQ ID NO: 224 - DNA, 780 bp, Porphyromonas gingivalis
atgaaactattactttatctcctattggtcttgtcgactctatccccgatgtattcgcaaatgctcttctcagagaatctcacaatgaatatagacagcaccaaaaccatacaaggaacgatattgcccgtactggatttcaaaaccgaaaaggaaaatgtgttcaccttcaaaaatactgccaatctcaatctgctgataaagcacggtcaagtaatcaacttaattaataagcttgagttttctacctatggcaataaagtaaccgtaagtggaggatatgtacacaccgaataccgctatttgttgcatcatgtttttgaggtttatccttatgtcgagtcgcaatgggcagaaagtagaggaatgaaatataaggtttctacgggattacagtcgcgttatcggctggtaaatagtgataactgtctcatgtttgcaacattgggggtatttttcgaattcgaaaagtgggaacagccagccactagcctctttgcaggaacgtatgcatacagccgaagtatcaaaagccacctgtctatcagtttcagacatcggttgggtgaacattgggaatttacaactacggctattcaccagggaaagcctgacagttattttaagaaggcacgttttggaggagctatcgacctcaaataccatatcacacctacgataggaatacgcggggcctatcggatcatctacgatactgcccctattgtacctgtgcggaaagattacaacaccgttgatgttggtatcgatatttcgttt

SEQ ID NO: 225 - DNA, 2502 bp, Porphyromonas gingivalis
atgaaacgaatcgttttatcatctttcctgttcgttctgtccatactttctttgatggcacagaacaataccctcgatgtacacatatccggtacgatcaaggatgcctcctccggcgaaccagtgccctatgccactgtaagcatccggctgacaggagcagataccacacaggtgttccgacaagtgactgacggcaacggctacttcgtcataggcctgccggcagctccctcctatcacctgacagcttcgttcgtaggtatgaaaacccataccatgcagattagtcggggaaatggacagcacgacatcaaatccatcgacatttctctcgaatccgaggacaaacaactctccaccgtcaccgtatcggcagcacgaccactggtgaagatggagatagaccgcctgtcctataatatgaaagatgaccccgcagccaagacgaacaacctgctcgaaatgctgcgcaacgttcctttggtaacggtggatggtcagggcaatatccaggtgaaaggatcttccaacttcaaaatccacctcaatggcaggccctcgaccatggtgagcagcaacccgaaggaggtctttcgctccattcctgcccatacgatcaaacgggtggaggtcatcaccgatccgggtgtaaagtacgatgcggaaggcacaagtgccatcctggacatcgtcacggaagaaggtaagaagctggaaggatattcaggttccatcacggccagtgtcagcaacaatcccacagccaacggtagtatctttctgacggcaaagtccggcaaagtcgggctgactaccaactataactactacggtggcaaaaacaagggctctcgctactttaccgaacgtactacatccatgctccaaacgatagaagaaggcaaagggcaagaaacctttggcggacacttcggcaatgccctcctctcattcgagatagattcgctcaatctctttacggtgggcggcaatgtacgcctttgggagatgaccaccgaccggaacagcgtagaaaaaagctttgccggcagcaacctcatgtcctacatagacagaaaactcaaaacacagatggatgccggatcatacgagctcaatgccgactatcagcacagcactcgcctgccgggcgaattgctcaccgtttcctaccgcttcactcacaatcctaataatagcgagaccttcattgaccaatggaagcgcgatccgctcaacacagctaatacgatccagtacgccggccagcactccaaatccgatgcgggcatggacgaacatacggcacaagtggactatacacgtcccttaggacaagcacattctttggaagcagggctgaagtacatctatcgtcatgccacgagcgatcctctctatgagatacgaccatccgaagatgctccgtggcagcccggctctctatatgcacagaatccgtcgaacggaaagttccgccacgatcaatacatcggagcagcctatgccggctacaactatcgtaaggatcagtattctttgcaaaccggcctccgagtggaaagcagcaggctgaaagcactctttcccgaaaacgcagcagcagatttctcccacaactcgttcgactgggtgccacagctcacgctcggctataccccctcgcccatgaagcagcttaagctggcctataacttccgaatccaacgtcctgcaatcggccaactgaatccctaccggctacagaccaacgattatcaagtacagtatggtaatcccgacctaaagtcggagaagcgtcaccacgtcggtctctcctataatcaatacggagccaaggtcatgcttacagcatcgctcgactacgacttctgcaacaacgccatccagaattacaccttctccgacccggccaatcccaatctgttccaccagacctatggcaatatcggacgagagcattctttcagcttgaatacctatgccatgtacacgccggccgtatgggtcaggattatgctcaacggaaatatcgatcgcacattccaaaagagcgaagcactcggcattgatgtcaattcatggtccggcatggtatactcaggcctgatgttcaccctgccgaaggattggactgtgaatctcttcggaggttattatcatgggggaagaagctaccagacgaagtatgatggcaatgtattcaacaatatcggtatagccaaacagcttttcgacaaaaaattgagagtctcgctgagcgcaaacaacattcatgcgaagtattcgacatggaagagccggaccatcggcaatggatttactatttattcggaaaatgccggtatacaacggagtgtttccctcagcctcacctacagcttcggtaagatgaatacacaagtgcgcaaggtagagcgtacgatcgtcaacgacgacctcaagcaaacctcatcccaaggacagcagggtggcggacaaggaaatcctaccggcaat

SEQ ID NO: 226 - DNA, 1197 bp, Porphyromonas gingivalis
atgagactctctgccattcttatcgctttgattgtgatgctgcctgctgtgcttagcgggcagcattattattccatggcgggagagcgactggagacggacagcattcgtccgaacgaactctcggcatcgatccgaagtgcgcttttctttcggaacaatgaatacaatgcacgttcggtcaaaggttatacgttgccgggtgcacgggtttccgcttttgcctcttactcgctgccggcagcacatggtgtgaagctttcgctcggagtatctaccctgaactactggggggcaagtcgctatccggccggtatcgcttattccgatttaccttattggacggactataacgactatgtacgcttgcgtatcctgccttatgtacaggccatgctgaagccgacggccacgactgctctcatgctgggcaatatagccggtggtacggctcacggactgatcgaaccgatctacaatcctgagttggatttgacggctgatcctgaagccggtgtgcaatttcggggtgattggacacgtttccgaatggatgtttgggtcaattggatgagcatgattttcaaaaatgacaatcatcaggagtcgtttgtctttggcttgtccactacttcgaaattgttatcgggtgaaggcaaatggcgactcgaactgcccttgcaggctattgccacgcatcgcggcggggaatacaactgggcgcagcaggataccgtgcatacatgggtcaatggagctgtcggacttaagctttcgtatcgccctcgtaccgacaaacccatgcagatttggggatctgcttatggtgtggcagccttgtcaagcggaggatacttcccttacgaaagagggtggggcggttatctttctctcggaatggacttggagcacttcgcttttcgtaccgactattggtacggcaggcattacgtttctccctttgctgcacctttcgccaattccctgacgtatgacaaacagcctcttacgaacggttggggcgattatattcgtctctatgccgactattcgtggcggatggcacgaagtgtttcgttggcggctgttgctcgggtatggttccagccttcggatcgttttgcgatgagccacgccttggaactgacgatgcgtatcgatcccaaattcccaatagcttttctgaaaggcaatcat

SEQ ID NO: 227 - DNA, 1146 bp, Porphyromonas gingivalis
atgaacaaatcgctattatcattggcatgcctcatcctgtgcggtatgccggccatcgcccaacagacaggaccggccgaacgcagcggcgagccttctctggccgaacgtgtattcggtctggagcagaagcagaaaaagctgaaggtgtacttaggcatacagtcgttctacgaccagccgcttgtcgatgacgaatcccatatcggacacttcaaggtacaggagctgcggatgtctgctcatggcgaactgaaccgccacctcagcttcgactggcgacaacgtctcaaccgtgccgccgacggcacttcgtttgccgacaatctctccaatgccatcgacatcgcaggtgtggactggcacccgaacgacaaggtgtctttcttcttcggacgtcagtacgcgcgtttcggagggatagaatacgacatgaaccccgtagagatctaccagtacagcgaccttgtggattacatgacctgctatacttcgggcgtgaacttcgcatggaacttccaccccgaacagcagctgcagctacaggtactcaatgcttacaacaaccgcttcgccgaccgctaccacgtgacacccgatgtcgctaccgccacgagctacccgctcctctactcggcacagtggaacggtaccctcctcggaggagcactgcatatgcgttacgccgtgtcgatggctcatcaggcccaagagcgtaatatgtggtacttcactgcgggcaacctgttcaatccgggcaaacggatcaacggatacctcgacctcacctactcgatcgagggattggacgacaaaggcattatgactgctcgctacggcaagggcaagaccctcacggacgtcaagtactatgctctggtatcgaagtggaacttccgcattttcgatcaggtcaatctcttcctcaaaggcatgtacgagaacggctatgcgcctgcccaatacggcgagagcagccacacgcgccactcctacggctatatgggaggggtggaatattaccctacggagaccaacttccgtctgttcgtcacctacataggacggcattaccggtacagtgcgaccgagacggaaagcaccaatgctcttcgcgccggtctgatctatcagatacctttctta

SEQ ID NO: 228 - DNA, 666 bp, Porphyromonas gingivalis
  modified_base (267)..(267): n is a, c, g, or t
  modified_base (524)..(524): n is a, c, g, or t
atgaaacatttgtttaagtcgacattagtacttctttgtgctctttctttttccggtacctatacctttgcacaagaaaataatacagaaaagtcacgatttgatttttctgttaggctgggacagggatatattgcaggttcaactaccaacctgatgtatgggtatacatctgctaacgatagacttttgtctggtgcaatttatctgggcttgacaccaagtaagaaagaaaatgcaaccggcgtagcatttcgtttcttatcnccctctccgggttattatgtcgatatatccggcaaagaaaataccttgaattatgcgttttacgttgtcggagcatataatagaatagccattcctatacgccctatcaaaaattttaatttcatcttctctacagaagtcggaatggcttggatgagtcgtcatgagcaaatttacaattctacttcgcagacttgggataagcagcgcaagtcgaggtcgggactggattttggtctcgggatgcatctgcaatnccacattaataagaccgtttactttatggcaggaaccgatcttacgtcttgcatgttcggaaaaaggatcaatgactaccagcaaaaggatcgaaccttcattgcacttatcgacaacagtattggcataggattaaacctc

SEQ ID NO: 229 - DNA, 1173 bp, Porphyromonas gingivalis
atgattatcaagaaaatgctgaaaaataaattggcccccttggccatactgttcctttttgctccaaaggctatgaaggctcaggagcaactgaatgtggtacacacctctgtgccatcgctgaatatcagtccggatgcacgtgcggccggtatgggggatataggtgtggcaacgacgccggatgcgtattcacagtattggaatccgagtaaatatgctttcatggatacgaaagccggtattagcttctcatatacaccctggctgtccaagctggtcaatgatattgccctgatgcagatgaccggtttctacaaattgggaacagacgagaatcaggctattagtgcttctctgcgttatttcacattaggaaagttggagactttcgacgaattgggcgaatccatgggagaggcccatcccaatgaatttgctgtcgatttgggctatagccgccagttgtcggagaacttctccatggctgttgcactgcgttacatccgctcagaccaaagcactcacaacaccggagagaatcaggccggaaatgcctttgcggcggatatagccggttatttgcagaagtatgtgctactgggtaatgcggagagcttgtggtcgttgggtttcaacgtaaagaatatcggaacgaagatctcctatgacggaggtgtcacgagttttttcatccctacttcgttgaatctcgggacggggctgttgtatccgatcgatgactataacagcatcaatttcaaccttgaacttagcaagctgcttgtacccactcctcctatcatggatcaaaacgatcaggccgggtatgaggctgcactcaagaaatatcaggaaacttcttcgatcagcggtatattctcttctttcggtgatgcgccgggaggactcaaggaagaattccgtgagattacatggggacttggggctgaatatagctatgacgataaattttttgttcgtgccggatattcatacctgcaccccaccaaaggcaatttgcagtacttcacggccggtgccggcttcaaaatgaacatattccgtatcgatgcttcctacctgttgtctacgatccagagtaatccgttggatcagactctgcggtttacgcttgctttcgatatggatggattgcgcaatttgttccac

SEQ ID NO: 230 - DNA, 1338 bp, Porphyromonas gingivalis
atgaaaacaacagttcaacaaattattctgtgcctggctttaatgatgtcaggtgtattgggcggaaacgcacagagcttttgggaagaaatagctcctccttttatcagtaatgagcctaacgtcaagtatataattcccaatatggggattgattcaaagggaacaatctatgtaaccgtgacaaaaaggattcagcagggagcaaattatacttctgagcaattgggtatgtactatcgaccattaggtgataatgaacagtggtggaaacatgatccgtattttgatgacaagatagttgcggatattcagacagatgcatatggcagagtttatgtatgtacgacttcttctcgagatcaagagtatcaactttatataaacgagcagaacgaatggaggtgtatattcaaaacttctgtgtctacatatgagcatggtatggctgtttttcgctcttcgacaggggtgacttatataggtaccaggcatcacatcttcgcatcaggtgtaaatgatttcgagttcaacactatctatgaagactctacacctatgagctgtcgctttgcagaggctacgaatagtggcaccatctatctggcattgatgcatgaaaccacaatgtctacgactatccttacttatcaaaacggtgagttcgtcgatatctcggaaagtgaattgagtaactcgattattgcatccatgtgctctaataaagaaggtgatataatagctcttgttacttcatatacaggatttatgagtggaacccttgcgatcagaaaagcagatgaaggcaaatggcaacttgttggcggagatatacagaatgcgatcgttcaaaatatatgcatgatggacgacaacaagattgcttgtgaagtcttcgggactcctaacggagtagatggtcggacaagggtttgtgtttctgacgcatctgtctttgattttgagtggtatgaagatgaaatatacggaggcctgatatttgacactttcttctatagcccttgggacaaacttctttatgcgaaatttggtgggattatgctcaggagtaaagagtcttttataacctctttcatttctccgacagttgtacaaggagtggatgtctatactttggccgggaagataaggatcgaaagtgaaactccggtgtctgaggtgttgcttttcgacctggctggcaggatggtacttcggcaaaccattgataataaaatctattcggacatagatactaacggactaaagcgaagcggtatttacgtagtctcggtgcggctctcttccggacaggtattcagtcataaggtgcaggta

SEQ ID NO: 231 - DNA, 924 bp, Porphyromonas gingivalis
atgataatccggtgtcttatccgtcgtccgagaaccgtcctgttcgggttgatattcgtggtaggtcttttctctgcgatggcgcaagagaaaaaggatagtctctctacggttcagccagtgccgaatagcagcatggtggagcagacccctcttctctccattgatcaccccgtcctgcccgcttcttttcagaatacccgtacactgaaaaggtttagagacaaacatctttccgatgctttgctcaatggattgaagcctcatcgctcatctttgcaattgaatgaggaactcaacttcgcggcagagcgtcgggatttcgtttctcccctcttgcaaactcgccacgctgccggtgtcctttcatggcgaccgaccgataggatgcatttttatacatcgggcaatatcggtcttggccatgatttattgaccggtgtgcgcaaggacttcggatggaatgctggtgccgacttcttgctgagtcaaaatcttacggcacatgtccaaggcggttggcagcagaatttcggctttatacctatgacggctgtcaatggccaactgcgttggcaagccaccgagagattgagttttaccaccggtatcgattatcgacaggtacagtggaatgctttcgataatagaacgttctcgcttaaaggaagtgctcgatacgaagtgatggacaatgtctttgtcaatggatttggcagctatcctctctacagcagtacgcgctcaggactcaatatggctgttccgatgcatggattcggccctcagtacggtggatcgcttgagctgaaagtctccgagcgattcggctttgccgtcggtatggagcgcgaatacaatatctggactcgtcggtgggaaacgcattactttgcttatcctgtattctatggcgataagaag

SEQ ID NO: 232 - DNA, 945 bp, Porphyromonas gingivalis
atgaaaacgaatagacgatacgcatttgttttgccgcttctgctactcaccggattgttggcatgggggcaggattcttcccacggtagcaatacagcgtttgcaactgattcttcgagtagagagttgcccacggagcagtccgcctaccgcattcattctgcctatatggtcggtggtggcggaagcataacgcgcgacacctatttgtcaccccttcgttatggaggatggacactgaatttgttgggagagaagacgttccctctcaaagcctccgattcccgttggatgatccgtaccgggcatgagctggattttgccctgatggacaatccggccaataatgctcatttctattccctgctgtataacggttccgctgcggctctttaccgccttggcgctaagcatctgcgagccgcgtggatggacaatctgcgcttggcattcggcccgggcttggaaatcgggcttggaggaatttatagtacacgcaacggcaataatcctgcgacattgaagctctacaccaatgccatcgcccaagcctcgataggatactacgtcccctccgaaacttttcccctgtattttcggttgctctcccagatcaatctcttcggtatagcctatggaaatggttttggtgagagctattacgagaattttttgctcaataacggcattgcaggctccctgcatttcacttatccgggcaagtttactcggttcacgacactcataacggcggatattcccattcggaacttctgtacgcttcgtgtcggttatcgctattcccatttgggctcttcgcttaacgcattggatactcgaatccacagtcatacggcttttatcggtttcgtcacggagttttaccgattccgtgggcgcaaagccatgaataccggtcggagaaccagtctttactatcatgat

SEQ ID NO: 233 - DNA, 855 bp, Porphyromonas gingivalis
atggtagtgacgctgctcgtaattgtcggtattgtggtagtagtgcggtactccttgcgcgtccacgtacataagaccggcactgttgtatcggcggccatatttggcttcatcctccttggaaagaccgttccatgcgatacccgtaacttcttttcctccgaaagtgatgaacctgagagccgtgttgctaccgaaatagcccacctgtgcgaaataggatttcagatccacgcttcctctatccacgtagccgtccgaaccgattttggacaggcgggcatccactgcccaatggcgaccgatgcgtccgctaccgagtttgaccgatcggcggaatgtgccgaacgaacctccgctcaaatcgacacggccataaggagccagtcccaaattatccgtacgcatattgacacttgccccaaaagctccggcaccattggtggaagtacccacacctcgctgcacctgaaggtcttcgatggaagaggcgaagtcgggcatattcacccaaaagacggactgagattcggagtcgttgaggggtactccattggtagttatgttgatgcgattggcatcggtgccacgcacgcgaaagccggaatatccgatacccgtaccggcatcgctggtggctaccacggagggagtcagcatcagcagataggggatgtcacgaccataattggacttggaaagttcggccttgcgaacgttggtgtaagcgacaggggttttcgccgtggcgcgagtagctacgacctgtacggtctggagctgcacattgctaagactatctatctcgctgttggagacgggtgcttgtgccgtcaggcagaaaggcaggacggc

SEQ ID NO: 234 - DNA, 1797 bp, Porphyromonas gingivalis
atggaaaacttaaagaacattcagcccagagaggatttcaactgggaagagtttgaggccggtggcgtccatgctgccgtgagtcgtcaggagcaggaagctgcttatgacaaaacgctcaataccatcaaggaaaaggaagtggtaatgggtagggtaactgctatcaacaagcgtgaagtggttatcaatgtagggtacaaatcggaaggtgtggtacctgcaacagaattccgctacaatcccgaactcaaagtgggagacgaagtggaagtttatatcgagaatcaggaagataagaagggccagctcgtcttgtctcaccgcaagggtcgtgccgctcgctcttgggagcgcgtgaacgaggctctcgaaaaagacgaaatcgtaaagggctatgtgaagtgtcgtaccaagggtggtatgatcgtcgatgtattcggtatcgaggctttcctcccgggatcacagatcgacgtgcgccccattcgcgactacgatgcattcgttgagaagacgatggagttcaagattgtgaaaatcaatcaagaatataagaatgtagttgtttcccacaaggtgctcatcgaagcagagctcgaacaacagaagaaagaaatcatcggcaagctcgaaaaagggcaggtactcgaaggtatcgtcaagaatattacttcttacggagtatttatcgacctcggtggagtggatggtcttatccatatcactgacctttcatggggtcgtgtggctcatccggaagaaatcgtacagctggatcagaagatcaatgtcgttatcctcgactttgatgaagatcgcaagcgtatcgctctcggactcaaacagctgatgcctcatccttgggatgctctcgacagcgagcttaaggtaggcgataaggtgaagggtaaagttgtggtgatggcagattacggtgctttcgttgagattgcacagggcgttgagggtcttatccacgtaagcgaaatgtcatggacacagcacttgcgttctgctcaggacttcctgcatgtaggcgacgaagtggaagccgtgatcctgacgctcgaccgcgaagaacgcaaaatgtcgctcggtctgaagcaactcaagccggatccttgggctgatatcgaaactcgtttccctgtaggctctcgtcaccatgctcgtgttcgcaacttcaccaatttcggtgtattcgttgagatcgaagagggcgtagatggccttatccatatttccgacctttcttggacgaagaagatcaaacaccccagcgagtttacggaagtaggtgctgatatcgaagttcaggtaatcgagatcgacaaggaaaaccgtcgtctcagcttgggtcacaaacagttggaagagaatccttgggatgtattcgagacggtattcactgtaggatctatccacgaaggaacggtaatcgaagtgatggacaagggtgctgtcgtttctctgccttacggtgtggaaggttttgccactccgaagcacatggtgaaggaagatggctcacaggctgtactcgaagagaagttacctttcaaggttattgagttcaataaggatgccaagcgaatcattgtatctcatagccgtgtattcgaagatgagcagaaaatggctcagcgtgaagccaatgcagagcgtaaggctgaagccaaagcggctcagaaagaagctgctgccgaagctgccaatcctgcacaggctgtagagaaagccactctcggagacctcggcgagctggccgctttgaaagaaaagctttcagaaaac

SEQ ID NO: 235 - DNA, 1650 bp, Porphyromonas gingivalis
atgggtagggtaactgctatcaacaagcgtgaagtggttatcaatgtagggtacaaatcggaaggtgtggtacctgcaacagaattccgctacaatcccgaactcaaagtgggagacgaagtggaagtttatatcgagaatcaggaagataagaagggccagctcgtcttgtctcaccgcaagggtcgtgccgctcgctcttgggagcgcgtgaacgaggctctcgaaaaagacgaaatcgtaaagggctatgtgaagtgtcgtaccaagggtggtatgatcgtcgatgtattcggtatcgaggctttcctcccgggatcacagatcgacgtgcgccccattcgcgactacgatgcattcgttgagaagacgatggagttcaagattgtgaaaatcaatcaagaatataagaatgtagttgtttcccacaaggtgctcatcgaagcagagctcgaacaacagaagaaagaaatcatcggcaagctcgaaaaagggcaggtactcgaaggtatcgtcaagaatattacttcttacggagtatttatcgacctcggtggagtggatggtcttatccatatcactgacctttcatggggtcgtgtggctcatccggaagaaatcgtacagctggatcagaagatcaatgtcgttatcctcgactttgatgaagatcgcaagcgtatcgctctcggactcaaacagctgatgcctcatccttgggatgctctcgacagcgagcttaaggtaggcgataaggtgaagggtaaagttgtggtgatggcagattacggtgctttcgttgagattgcacagggcgttgagggtcttatccacgtaagcgaaatgtcatggacacagcacttgcgttctgctcaggacttcctgcatgtaggcgacgaagtggaagccgtgatcctgacgctcgaccgcgaagaacgcaaaatgtcgctcggtctgaagcaactcaagccggatccttgggctgatatcgaaactcgtttccctgtaggctctcgtcaccatgctcgtgttcgcaacttcaccaatttcggtgtattcgttgagatcgaagagggcgtagatggccttatccatatttccgacctttcttggacgaagaagatcaaacaccccagcgagtttacggaagtaggtgctgatatcgaagttcaggtaatcgagatcgacaaggaaaaccgtcgtctcagcttgggtcacaaacagttggaagagaatccttgggatgtattcgagacggtattcactgtaggatctatccacgaaggaacggtaatcgaagtgatggacaagggtgctgtcgtttctctgccttacggtgtggaaggttttgccactccgaagcacatggtgaaggaagatggctcacaggctgtactcgaagagaagttacctttcaaggttattgagttcaataaggatgccaagcgaatcattgtatctcatagccgtgtattcgaagatgagcagaaaatggctcagcgtgaagccaatgcagagcgtaaggctgaagccaaagcggctcagaaagaagctgctgccgaagctgccaatcctgcacaggctgtagagaaagccactctcggagacctcggcgagctggccgctttgaaagaaaagctttcagaaaac

SEQ ID NO: 236 - DNA, 1374 bp, Porphyromonas gingivalis
atgatcgtcgatgtattcggtatcgaggctttcctcccgggatcacagatcgacgtgcgccccattcgcgactacgatgcattcgttgagaagacgatggagttcaagattgtgaaaatcaatcaagaatataagaatgtagttgtttcccacaaggtgctcatcgaagcagagctcgaacaacagaagaaagaaatcatcggcaagctcgaaaaagggcaggtactcgaaggtatcgtcaagaatattacttcttacggagtatttatcgacctcggtggagtggatggtcttatccatatcactgacctttcatggggtcgtgtggctcatccggaagaaatcgtacagctggatcagaagatcaatgtcgttatcctcgactttgatgaagatcgcaagcgtatcgctctcggactcaaacagctgatgcctcatccttgggatgctctcgacagcgagcttaaggtaggcgataaggtgaagggtaaagttgtggtgatggcagattacggtgctttcgttgagattgcacagggcgttgagggtcttatccacgtaagcgaaatgtcatggacacagcacttgcgttctgctcaggacttcctgcatgtaggcgacgaagtggaagccgtgatcctgacgctcgaccgcgaagaacgcaaaatgtcgctcggtctgaagcaactcaagccggatccttgggctgatatcgaaactcgtttccctgtaggctctcgtcaccatgctcgtgttcgcaacttcaccaatttcggtgtattcgttgagatcgaagagggcgtagatggccttatccatatttccgacctttcttggacgaagaagatcaaacaccccagcgagtttacggaagtaggtgctgatatcgaagttcaggtaatcgagatcgacaaggaaaaccgtcgtctcagcttgggtcacaaacagttggaagagaatccttgggatgtattcgagacggtattcactgtaggatctatccacgaaggaacggtaatcgaagtgatggacaagggtgctgtcgtttctctgccttacggtgtggaaggttttgccactccgaagcacatggtgaaggaagatggctcacaggctgtactcgaagagaagttacctttcaaggttattgagttcaataaggatgccaagcgaatcattgtatctcatagccgtgtattcgaagatgagcagaaaatggctcagcgtgaagccaatgcagagcgtaaggctgaagccaaagcggctcagaaagaagctgctgccgaagctgccaatcctgcacaggctgtagagaaagccactctcggagacctcggcgagctggccgctttgaaagaaaagctttcagaaaac

SEQ ID NO: 237 - DNA, 1278 bp, Porphyromonas gingivalis
atggagttcaagattgtgaaaatcaatcaagaatataagaatgtagttgtttcccacaaggtgctcatcgaagcagagctcgaacaacagaagaaagaaatcatcggcaagctcgaaaaagggcaggtactcgaaggtatcgtcaagaatattacttcttacggagtatttatcgacctcggtggagtggatggtcttatccatatcactgacctttcatggggtcgtgtggctcatccggaagaaatcgtacagctggatcagaagatcaatgtcgttatcctcgactttgatgaagatcgcaagcgtatcgctctcggactcaaacagctgatgcctcatccttgggatgctctcgacagcgagcttaaggtaggcgataaggtgaagggtaaagttgtggtgatggcagattacggtgctttcgttgagattgcacagggcgttgagggtcttatccacgtaagcgaaatgtcatggacacagcacttgcgttctgctcaggacttcctgcatgtaggcgacgaagtggaagccgtgatcctgacgctcgaccgcgaagaacgcaaaatgtcgctcggtctgaagcaactcaagccggatccttgggctgatatcgaaactcgtttccctgtaggctctcgtcaccatgctcgtgttcgcaacttcaccaatttcggtgtattcgttgagatcgaagagggcgtagatggccttatccatatttccgacctttcttggacgaagaagatcaaacaccccagcgagtttacggaagtaggtgctgatatcgaagttcaggtaatcgagatcgacaaggaaaaccgtcgtctcagcttgggtcacaaacagttggaagagaatccttgggatgtattcgagacggtattcactgtaggatctatccacgaaggaacggtaatcgaagtgatggacaagggtgctgtcgtttctctgccttacggtgtggaaggttttgccactccgaagcacatggtgaaggaagatggctcacaggctgtactcgaagagaagttacctttcaaggttattgagttcaataaggatgccaagcgaatcattgtatctcatagccgtgtattcgaagatgagcagaaaatggctcagcgtgaagccaatgcagagcgtaaggctgaagccaaagcggctcagaaagaagctgctgccgaagctgccaatcctgcacaggctgtagagaaagccactctcggagacctcggcgagctggccgctttgaaagaaaagctttcagaaaac

SEQ ID NO: 238 - DNA, 720 bp, Porphyromonas gingivalis
atgaaaaaagctattctttccggagcggccttgctcctcggcctatgtgccaacgcacaaaacgtgcagttgcactacgatttcggtcattccatctacgacgaactagatggacgtcccaaactgactaccacagtggaaaacttcacacccgacaaatggggaagcaccttcttcttcatcgacatggattacacgggcaagggtatccagtcggcctattgggagatttcgcgcgaactgaagttttggcaagctcccgtttccattcatttggagtacaacggaggcctctccacaagctttactttcggacacgatgctctaatcggtgccacctacacctacaacaacccctcctttacacgtggatttacgatcacgcccatgtacaagcatctgggtgcgcacgacttccacacctatcagatcaccggcacttggtacatgcactttctggacggtctgcttaccttcaacggcttcctcgatctttggggtttcccccaagagaacccaatcgggggccctgtgctcaaagaaggggataagttcgtattcctgtccgaaccgcagttctggatcaacctcaatcgcatcaaaggcatcgacaaggatttcaatctcagcatagggacagagatggaaatcagcaggaacttcgctcgcatggacaaattctcctgcatccctactcttgcggtcaaatggactttcaac

SEQ ID NO: 239 - DNA, 1302 bp, Porphyromonas gingivalis
atgtataaagactataagggtttgtatgcgtcgcttcggtggtatgccctgatcattgggttgctatttgcagcagacggtatacaggctcagaacaacaactttaccgagtcgccttacactcgcttcggccttggccgtctcggagaacggacgactattagtgggcattccatgggaggactcggcgtcggtctgcgtcagggcacatacgtcaatgccgtcaatcctgcttcatactcggctgtggattcgatgacgtttatcttcgatttcggtgcatctaccggaattacgtggtatgccgagaacgggaaaaaggacaataggaaaatgggaaacattgagtatttcgccatgctttttcctatttccaaatccattgctatgagtgcgggagtgcttccttactccgcatccgggtaccagttcggatccgttgatcaagtggaaggaggcagcgtccagtacacccgtaaatacttggggacaggcaatctgaacgatctctatgtcggtataggtgcaaccccgttcaaaaacttctcaataggagccaatgcttcatccctttttgggcgattcacacacagcaggcaggtaatcttctccacggaggctccttacaatcccgtacatctctcgacgctgtacttgaaggctgccaagttcgacttcggtatgcagtatcaccttcttctcaaatcagatcgttcgctcgttatcggtgccgtctattctccgcgggtgaagatgcatagcgagctgactcagataaagaatcaggttcagaacggtgtagtagtggagagcgaaacccaagaatatatcaagggaatggactattataccctgcctcatacattggggataggtttttcttatgaaaagaaagataaacttctcttaggagcagacgtccaatatagtaaatggaaaggcgagaaattttataaatccgattgcaaattccaggacagaatacgggtatctctcggcggagagatcataccggatataaatgccgttgggatgtggcctaaagttcgctatcgcttcggtttacatggtgaaaattcttacctgaaagtgccgactaaaggcggtgtatatcaaggataccatatcgtaggtgctgtattcggtataggaatcccgctcaatgacagacgttcgttcgtaaatgtctctcttgaatatgaccgattgatcccgaaggagggtatgatcaaagaaaatgctctgaaattgaccttcggcctcacgttcaacgagtcatggtttaaaaagctgaaactgaac

SEQ ID NO: 240 - DNA, 2778 bp, Porphyromonas gingivalis
atgcgatcgatttatcaattactgttgtcaatactccttgcttctcttggtttcgtcgggctggaagcccaacaagccggagtagcaggtagagtattggacgaagaaggcaaccccatgattcaagccaacgtacagcttgtacagagtaccggccaagtagccgttgccgcaggtgccactaatgaaaaagggttgttcagcctgaaaacgtcacaggagggtgactacattctgcgcgtttcatatgtaggttacactacccacgacgaaaaaatatctcttagaaacgggcaaaccattacgctcaaagatatatccatgaacgaagatgcccgtcttctacagagtgtgacggtgcaggctaaagcggcagaggtcgtggtacgcaacgatacgctcgaattcaatgccggatcctataccgtagcacagggagcttctatcgaggaactgatcaagaagctacccggagcagagatcggatccgatgggaagatcaccatcaacggcaaggacattagcaagatccttgtcgatggcaaagagtttttctccaaagatccacaggtggcaataaagaatcttccggccgatatggtcaataaagtacaggtactgaacaaactgagcgagctgtcgcggatgagcggtttcgatgatggagaagaggagaccgtaatcaacctgacggtgaagcccgaaaaaaagaaaggcctcttcggaacgcttcaggccggctacggtaccgaccaacgctatatggccggagggaacgtcaatcggttcgatggaaataagcaatggacattgatcggtagtgcgaacaatacgaacaatatgggctttagcgagatggacagcgagatgggatccatgaccttcttctctccccaaggcggtggtcgacgcggcttcggcaatagtggaggtgttacgtcttcgtcgatgctgggcggcaacttcagtgtcgaattctcctctgcccttaatacaggaggcgatgcacgctacggatacaacgacaaggccatagagacgaccaaacgcgtggaaaatatcctcgccgaagggaatacttatatggacgaaaatatattggaacgctctttctctcacaatggtcaggcgcgatttaggatgcaatggaaaccgtccgaacgtaccgaagtggtattcgagccggatctttcgatatccaagatcgatgggttctttaacgacacatacgagacgaaagatgccaccggaatctctatcaacaaaggttctatccaccaaactacacaaggaaacaacttcagactgaacggagaattggatatcagtcacaagctcaacgacgaaggccgtacgatcagtgcctccgtcagtggcggtctgaccgacgaagacggagatggcatatatcaggctgtgctccaaagcgtggagacgaatcaaaagcaattcaacgacaactccaacctgcaatatcggcttcgcctctcgtatgtggaaccgttgggtaaaaactacttcgcacaagcgattctgaacagacgtttctcccgtcgcaattcggatcgtgaggtgtaccgactgggcgatgacgggcaatactccatattagacagtcagtacggactctcctacagtaacgagttcacccagtatcgcatcggactcaacctcaagaagattgccaaaacgtgggactacaccgtaggattcaatgtggatcccaacagaactgtcagctatcggagcgtagccggagtagagcaggacaaactggctttcaatcgtgtcaatctctccccgatgctccgaatcaactacaaaccgagcaggactaccaacctccgagtggactaccgaggacgcacgacacaaccatccatcaatcagatcgctcccgttcaggacatcacgaatccgctattcgtgacggaaggcaatcccggtctgaagccgagctattccaacaatgtgatggccatgttctcggacttcgatgccaaaagtcagcgagctttcaacattgttttcttcggcaactatacattcgacgacatcgtccccaatacgcactacgatccgtctacagggatccgtaccactcgttacgaaaacgcctccggtacgtggcaagcgaatcttcatgggacactatcgcttccactcaagaacagggcattttctttcaggatgtccttgttcaacaggttggccgaaggacaaagcttcatcaatgacgataagaacaaagctctctctttccgaacgagggaacgcctgacgctgacctatcgcaacaattggatcgatacgagtatcggtggcaatatcggattctatatggcgaataatagtctgagcggacagaaagattctcgcacatacgattttggcggcaattatcaagttgccctaacgcttccctatggattccgtatcgacagcgatgttgaatacaatacgaactccggttacagcggaggattcagtctggacgaatggctttggaatgcttcgctttcatacagcttcctccgtgacaaggccggtacactgcgtgtcaatggctatgacatcctcggtcagcggtcaagtatcagccgttctgcttcggccatcaatatagaagagagcatgtccaatacgatcggacgctacgtgatggtggactttatctaccgattcaacgccttcagtggtggtggatctcgcagcgatcatcagcgtggcaatatgaatcgtccgggcccacctttcggcggtggcagacgaccgtcc

SEQ ID NO: 241 - DNA, 1200 bp, Porphyromonas gingivalis
atggttatgaagctgattaaaagaagtttgctcctgcttggagcggtactgctgattacgcttcctgcgtactcgcagaatgatgacatcttcgaagatgacatctatacatcgcgaaaagaaatacgtaaacaaaaccaagttaaagactggcaaaaccaagaggacggatacggcgacgatacggaatatacagtggcttccgatcgggacattgacgcctacaatcgtagagatggccagtcctacgatgggaaaaagttgtccaaagacaagaaaagagactccactcgttcttctgttcccggtcgctatagtcgccgcttggctcgattctataagccgaatacgatcgtcatttcaggtgccgacaatgtatatgtaactgatgatggtgagtatttcgtctatggagacgaatactatgatgacgcgtcgtctgtaaacatttacatcaacagtccttggtgcgatccgttcccttatacgtcatggtatccatctttctccggctggtacaactatacgtggaactatccatggttctactacggtagccatatcggatggggcggttattaccccggatataattggtattggagctactactatgatcctttctacaatccctatggaatcggtatgggttggggatatccttatggctggggcagctattacggttggggtggctatccgggagtgatacatcactaccaccactaccccaagaagacctattccaatggtcagcattccggagcttactattcttatggccgaccgaatcgtatcaaaggtggaacgtccggtgccaaacttgggacaggacgctacgatagaattcaaaattcgtcttcgcaaaaaaataagttcggattgcagtcgaacaaacccaataataatctgcaaaatgtcaagtcgggacgtaccggccgagccaatagagaccgaaatatagaaacggtaactccaaacaacgggcaaaagcagaatcgtcccgtattccagcagaatcagtccggcaatgaccgaccgaccggacggaatatccgcagcgagagacagggggaaaataacgataggacattttcgactccttctcgtagcaatagtaacggtggcttctccacgccttctcgctcttcttccggctctatgagcggaggtggcggacgtagtggccggggacgcaat

SEQ ID NO: 242 - DNA, 1194 bp, Porphyromonas gingivalis
atgaagctgattaaaagaagtttgctcctgcttggagcggtactgctgattacgcttcctgcgtactcgcagaatgatgacatcttcgaagatgacatctatacatcgcgaaaagaaatacgtaaacaaaaccaagttaaagactggcaaaaccaagaggacggatacggcgacgatacggaatatacagtggcttccgatcgggacattgacgcctacaatcgtagagatggccagtcctacgatgggaaaaagttgtccaaagacaagaaaagagactccactcgttcttctgttcccggtcgctatagtcgccgcttggctcgattctataagccgaatacgatcgtcatttcaggtgccgacaatgtatatgtaactgatgatggtgagtatttcgtctatggagacgaatactatgatgacgcgtcgtctgtaaacatttacatcaacagtccttggtgcgatccgttcccttatacgtcatggtatccatctttctccggctggtacaactatacgtggaactatccatggttctactacggtagccatatcggatggggcggttattaccccggatataattggtattggagctactactatgatcctttctacaatccctatggaatcggtatgggttggggatatccttatggctggggcagctattacggttggggtggctatccgggagtgatacatcactaccaccactaccccaagaagacctattccaatggtcagcattccggagcttactattcttatggccgaccgaatcgtatcaaaggtggaacgtccggtgccaaacttgggacaggacgctacgatagaattcaaaattcgtcttcgcaaaaaaataagttcggattgcagtcgaacaaacccaataataatctgcaaaatgtcaagtcgggacgtaccggccgagccaatagagaccgaaatatagaaacggtaactccaaacaacgggcaaaagcagaatcgtcccgtattccagcagaatcagtccggcaatgaccgaccgaccggacggaatatccgcagcgagagacagggggaaaataacgataggacattttcgactccttctcgtagcaatagtaacggtggcttctccacgccttctcgctcttcttccggctctatgagcggaggtggcggacgtagtggccggggacgcaat

SEQ ID NO: 243 - DNA, 1743 bp, Porphyromonas gingivalis
atgatccgcaagttgatcttactgcttgctctgatgccggtagcctctgtggcttttgcggtaccaacggacagcacggaatcgaaagacaatcgtatccttacaagcatgcaatcctcctctttgaatagggatgatgctccggataaatggcaacctatgcatgccaatttcagtattcagagcgatatgctgctttctactgcccaaaagtccaagaacacctggttcggcaactcctatatcatgggtataatcaagaacaattatctggagtttggtgcccgtttcgaggatctctataagcccctgcccggacatgaacccgagatggggcgtggcgttcctcacatgtatgtgaagggaagctatcattgggcggagctgactatgggagacttctacgatcagttcggtagcggtatggtattccgcacctatgaagagcgcaacctcggtatagacaacgcggttcgcggcggacgtatagtactcactccttttgatggagtgcgtgtcaagggtattgcaggacagcagcgtaactacttcgaccgcacgggcaaggtattcaattccggccgaggctacctactgggttctgatctggagctgaatgtagagcgttggagcagtgccatgcgcgacaatgactatcatttggctatcgggggatcgttcgtttccaaacacgaagcagacgaagatatatttgtgggtgtaggcgaagatcgcaagcgactcaacctgccgctcaatgtcccgattatgggcctgcgcaccaactttcaaaaaggaggtctcgccctctacgcagagtatggatacaaatacaacgatccctcggcagacaatgactatatctaccacgacggacaggctgcactcctctctgcctcatactccaaaaaagggatgagtatcctgttgcaggccaaacgttgtgagaactttgctttccgcagcaagcgaagtgcccagctcacaccgcttatgatcaactatatgccggcttttacccaagctcacacttatacgctggcggccatctacccctatgctactcagcctcagggagaatgggctttccaaggtgaactgcgttacaactttgctcgccggacagctctcggtggacgctacggtaccggcttgcgtatcaacgtttcgcatgtgcgtggtctggacaaaaagatgctcaaagagaatcccgacgaactgatcggaacggatggctacaccgtttctttcttcggcatgggcgacctctattattcggatatagatgtggagattactaaaaaggtaagcccaggattcaactttacgctcacctacttgaatcagatctacaataacaaggtactgcacggtgcagccggagagaagcctgagaagatctatgccaatatcttcgtctatgatggtaagtataagctgagtaataaggtagccctccgtaccgaactgcaatatttgcacacgaagcaggatcagggtgactggatctacggcatggccgagctctctatcctgccttctctgatgctttccctctcggagcagtataatatcggagagaccaagaaacattatgtcatggggtctgtcacctatactcacggagcacatcgagtagctttctctgcaggcaaaacccgtgcagggatgaactgctcgggaggtgtatgtcgtgtggtccctgagactcagggattctacctttcttatagcaccaatctg

SEQ ID NO: 244 - DNA, 717 bp, Porphyromonas gingivalis
atgcgttctttatttttgagcgcgttgcgcagctcctctctccatggttcagagcgacgcagtcggataagttcttctgtagtcatgtcaataaggcagaaaataaggttattccatctctcggtatgcgcccaaacgcatgatcatctcatcgaaatccacttggtgtgcatcgaattcggggccatcgacacagacgaatttcgtctgtcctcccacgcttatacgacaagccccacacataccggtgccatccaccataattgtattgagagaagctatggtcggtatctcgtaacgtttggtcaggagagaaacgaacttcatcatcacagccggcccgatcgtaacgcagaggtctaccgtttcccgtttgataacgctttccactccatccgttacgaggcctttcgtcccataagacccatcgtctgtcatgatgatcacttcatcgctattggctcgcatttgttcttcaaggataaccagatctttagttctggcagccaatacgacaattacacggttgcctgctttgtggaaagcctccacgatcgggagcaaaggagccacacccacaccgcctccggcacaaaccactgtgccgaccttttcgatatgcgtactctgtcccagcggacctaccacatccgtgatatagtcgccgacttcgagttcggccaatttcttggaagatttgcccacggcctgaaccac

SEQ ID NO: 245 - DNA, 633 bp, Porphyromonas gingivalis
atgtcaataaggcagaaaataaggttattccatctctcggtatgcgcccaaacgcatgatcatctcatcgaaatccacttggtgtgcatcgaattcggggccatcgacacagacgaatttcgtctgtcctcccacgcttatacgacaagccccacacataccggtgccatccaccataattgtattgagagaagctatggtcggtatctcgtaacgtttggtcaggagagaaacgaacttcatcatcacagccggcccgatcgtaacgcagaggtctaccgtttcccgtttgataacgctttccactccatccgttacgaggcctttcgtcccataagacccatcgtctgtcatgatgatcacttcatcgctattggctcgcatttgttcttcaaggataaccagatctttagttctggcagccaatacgacaattacacggttgcctgctttgtggaaagcctccacgatcgggagcaaaggagccacacccacaccgcctccggcacaaaccactgtgccgaccttttcgatatgcgtactctgtcccagcggacctaccacatccgtgatatagtcgccgacttcgagttcggccaatttcttggaagatttgcccacggcctgaaccac

SEQ ID NO: 246 - DNA, 2343 bp, Porphyromonas gingivalis
atggatcgtcctaagccttcatatattgttcgaatagcagccattctctgcttgtttgtcggcaggcctttgtttgcgcagagctatgtggactacgtcgatccgctgatcgggacgctaagttcttttgagctgagtgcgggcaatacctatccggtgatcggtttaccgtggggaatgaatagctggacaccgatgaccggtgtacccggtgacggctggcaatatacctactcggcacacaagattcgcggattcaaacagacccaccaacccagtccttggatcaacgactacggccaattctcccttcttccccttacggcaccgcagaagccatcatcgaacgactccatagctctgactaaatggtgcaagcaactcttttcggacgaacagacctcgtggttctcgcacaaagcggagacggcgacgccatactattatagtgtctatttggccgattacgacacacgcgtggagatggctccgaccgagcgtgcagctatctttcgcatacgttattccggcaataccgaaagtggctccggtcgatggcttcgtcttgatgcctttaccggtggttcggagattagcatcgtggatcctcacaccgtagtgggcatatctcgcaagaatagcggaggtgtgccggctaacttcgcctgttatttcatcctgcagtccgatactcctatggccgatgtcctgcttgagacagataccggcaagtcagacgaaggcacaagggcatgggcagcctgtcgcttcgattcgcaagaagttaccgtccgggtggcatcttcttttatcagtgtcgagcaggccgaaagaaatcttgcggaagtcaaagggcagagtttcgaccggatcagacttgccggtcgcgaagcttggaataaggtgctcggacgcatacatgtggaaggaggaacgaaggatgagcgcactacattctattccgcactctatcgctgtctgctttttccccgtcgcttctatgaggaggatgcttccggcaattttgtgcattacagcccctacaatggagaggtacttcccggttatctctataccgataccggattttgggacacttttcgagcccttttccccctgctcaatctgctgtatcccgatgaaaacattaaaattcaggaaggtctgctgaatgtatatcgcgagagtggctttttccccgaatgggccagtccgggccatcgggattgtatgataggcaacaactctgcttctgttctggcggatgcctacctcaagggtgttcgggtagaagatacccgtacactgatgaacggactcttgcatgctacgaaagccgtccatccgaaaatctcctccacgggtcgcaaaggttgggagtggtacaactccttaggttatgttccggctgatgcaggcatcgacgaaagtgctgcccgtacgctcgaatatgcttataacgattggtgcatcctccgactggggcgcacattgggttgggatagagctgcattggacacgttggctcatcgttcgatgaactatcgtcatctgttcgatccggaaaccaaactcatgcgcggtagaaatcaggatggtagtttccggacacctttttcccctttcaaatggggagatgtattcacggagggcaatgcctggcactacacttggtcggtctttcatgatgtgcaggggcttatcgacctgatgggaggagatcgcccgttcgtgtctatgctcgattcggtattcaatactcctcctatgttcgatgagagctattacggatttgtcatccacgaaatcagagagatgcaaatagcggatatgggcaattatgctcatggcaatcaacccatacagcatatgatatatctgtataatcatgccggtcatccatggaaagctcaggagagactacgcgaagtgatggggcggctctatcgtcctactccggatgggtattgcggcgatgaagacaacggacagacttcggcttggtacgttttctctgctttaggcttctatcctgttacacccgctacggatcagtatgtgctcggttcgccgattttttccaaggtaatactctcttttcccgacggacacaaaacggtgttgcatgctccggccaacagtgccgatacgccttacatccgctcgatcagcgtagaaggaaaagaatggagctgcaattacctgactcacgaacagcttcgctcttctgcatccattcaatggatgatggacacgaaacccaattataatcgtggtatgaaggaaagtgacagaccttattccttctccacggagcaacagcgtcgcgctaatcacagtaat

SEQ ID NO: 247 - DNA, 813 bp, Porphyromonas gingivalis
atgatgaaatccatgcgcagcgtgctgttgctactctttccattgtctttgatcactgctttgggctgtagcaataacaaagctgccgaatcgaagtctgtctctttcgattcggcctatctcgaacgctacatccctctgcgggcagacatagatacgccatcgctgcatgtgatgatcagctacgtctatccttcgggagatgatatgctcacagagattttcaacggtttgctcttcggcgacagcctgatggattcctcttcgccggagaatgccatggaaggctatgcacagatgctgggagaagactatcgctctaacaatgccgaagccaatctgcaagggcttccttctgaccttttggactatatctacaagcaggaaaataccatcgcttattgcgatacgggattgatctccacgcgcatcaatacatatacttacgaaggcggtgcacatacggagaatacagtccggtttgccaacatccttcgcaccaccggcaaggtgctcgaagagcgagatatattcaagatcgactatgcggaaaggctgtccgcactcatcataggacaattggtgcacgatttcggcaagaccacacctgccgaattggatgcaataggtttcttcaacgcagaagaaatacagcccaatggcaattttatgatcgatgacaaaggtctcacatactgtttcaatgagtatcagatagctgcttatgccagaggtgctgtctatgtccgtctcggatatgacgtattggctcctttgctaagggatgattccccactaaagcgttacttgccg

SEQ ID NO: 248 - DNA, 810 bp, Porphyromonas gingivalis
atgaaatccatgcgcagcgtgctgttgctactctttccattgtctttgatcactgctttgggctgtagcaataacaaagctgccgaatcgaagtctgtctctttcgattcggcctatctcgaacgctacatccctctgcgggcagacatagatacgccatcgctgcatgtgatgatcagctacgtctatccttcgggagatgatatgctcacagagattttcaacggtttgctcttcggcgacagcctgatggattcctcttcgccggagaatgccatggaaggctatgcacagatgctgggagaagactatcgctctaacaatgccgaagccaatctgcaagggcttccttctgaccttttggactatatctacaagcaggaaaataccatcgcttattgcgatacgggattgatctccacgcgcatcaatacatatacttacgaaggcggtgcacatacggagaatacagtccggtttgccaacatccttcgcaccaccggcaaggtgctcgaagagcgagatatattcaagatcgactatgcggaaaggctgtccgcactcatcataggacaattggtgcacgatttcggcaagaccacacctgccgaattggatgcaataggtttcttcaacgcagaagaaatacagcccaatggcaattttatgatcgatgacaaaggtctcacatactgtttcaatgagtatcagatagctgcttatgccagaggtgctgtctatgtccgtctcggatatgacgtattggctcctttgctaagggatgattccccactaaagcgttacttgccg

SEQ ID NO: 249 - DNA, 801 bp, Porphyromonas gingivalis
atgcgcagcgtgctgttgctactctttccattgtctttgatcactgctttgggctgtagcaataacaaagctgccgaatcgaagtctgtctctttcgattcggcctatctcgaacgctacatccctctgcgggcagacatagatacgccatcgctgcatgtgatgatcagctacgtctatccttcgggagatgatatgctcacagagattttcaacggtttgctcttcggcgacagcctgatggattcctcttcgccggagaatgccatggaaggctatgcacagatgctgggagaagactatcgctctaacaatgccgaagccaatctgcaagggcttccttctgaccttttggactatatctacaagcaggaaaataccatcgcttattgcgatacgggattgatctccacgcgcatcaatacatatacttacgaaggcggtgcacatacggagaatacagtccggtttgccaacatccttcgcaccaccggcaaggtgctcgaagagcgagatatattcaagatcgactatgcggaaaggctgtccgcactcatcataggacaattggtgcacgatttcggcaagaccacacctgccgaattggatgcaataggtttcttcaacgcagaagaaatacagcccaatggcaattttatgatcgatgacaaaggtctcacatactgtttcaatgagtatcagatagctgcttatgccagaggtgctgtctatgtccgtctcggatatgacgtattggctcctttgctaagggatgattccccactaaagcgttacttgccg

SEQ ID NO: 250 - DNA, 777 bp, Porphyromonas gingivalis
atgaaaaaaactactttgacaggatcgatatgtgctttactcctgtttttgggtctctcggccaatgcccaatcgaagttaaagatcaagagcattgaggcagctaccactttcagttcggccacggccggaaatggttttggtggcaatatcttcggcatggacatgagcatacggatgagggtacaccacagcattctgcccgaagggttggatttttcggtaggaatacatgaaagaagagcacactgggaagaggccggaagtccgaagctcatgtatacgaatgtcccaagtatcattggtattgttgaaaaggtaatagtcttcgaagacgcagaagacttttttgacaaaaaagctctcggccgcttcctcatcagtttggggatatcctataccaagcatctgggagcgtattggggatggaccaatgacgcccatattcttttctcaccgatacccaagagcaaggtccactatgacacctacacaagagctggcagtgaccttgtacttcagtccgaagatgttgccacagtgagcaatggcttttcaccggggatcggactcaaaagttctatttggtggaaaatgcccatcaagagcaaatatgattttcgcctcggtttcagcctgggctatgagtatctgaacctgctatatccgtatcgtaatttcaagctggatggaaataagccgctttcagcactatctcctcgcatgaaccacatcggccatgtgggcttcaactttaccgtgggtctttggactaat

SEQ ID NO: 251 - DNA, 3798 bp, Porphyromonas gingivalis
atgggcaagtataaaagagctaagtaccgctattggctttttcctttctgttcggattattatacctttgagggagttacttttttatgcgcatctgacgatatgacaaccaagaaaccccaagccattttagacttagagaaggcctataacattgaaattcctgatctctcctcacaagaagggataagctggtcggtaaatagatatttcaagcaagattcctccggtgcagtcgttgagctttgcttgcgagaatgtcagatagaaagcatgacttggcttattgattttcctgctctaaaaaagcttgatctatcgtataaccaaatcagtaagctagagggtctagaacgtcttacttcgttaacaaaacttcgtctaagaagtaaccaaatccgtaaactagagggcctggatagtctcacctcgctaacaaaactttctctctccgataaccaaatcagtaagctagagggtctggaacgtctcacctcgttagcggagctttatcttttggataaccaaatcagtaaactagagggtctggaacgtctcacgtccttagcaacgcttgaactatcgggtaaccaaatccgtaagctggagggtctggaacgtctcacgtccttagcaacgcttgaactatcgggtaaccaaatccgtaagctagagggtctggaacgtctcacttcgttaacaaagcttcgtctaagaagtaaccaaatcagtaagctagagggtctggaacgtctcacgtccttagcaacgcttgaactatcgggtaaccaaatccgtaagctggagggtctggaacgtctcacgtccttagcaacgcttgaactgtcgggtaaccaaatcagtaagctagagggtctggaacgtctctcttcgttaacaaagcttcgtctaagaagtaaccagatcagtaaactagagggcctggaacgtctcacctcgctaacaaaactttctctctccgataaccaaatcagtaagctagagggtctggaacgtctcacctcgttagcggagctttatcttttggataaccaaatccgtaagctggagggcctggaacgtctcacctcgttaacaaagcttcgtctaagaagtaaccaaatcagtaaactagagggcctggatagtctcacctcgctaacaaaactttctctctccgataaccaaatcagtaaactagagggcctggaacgtctcacgtccttagcggagctttatcttttggataaccaaatccgtaagctggagggtcttgatggtcttgcttccttaacaaggcttagtctaaggcgcaaccaaatcagtaagctggaaggactagacagactaaaggttttgagaaaacttgatgtttcgggcaatgatattcaatctattgatgatattaagctattggctccgattctggagcaaactttagaaaaactgagaatccatgacaatccatttgttgcatcatcaggcttgatactctctccttatgataatcatttgccggagattaaagctcttcttgaaaaagaaaaagaaaaacagaaaaagacttcagttgaatatcacccattttgcaaagtaatgctattgggaaatcattcttcgggtaaaacaacatttcttagtcaatacgatacaaattatacgtatcagaaaaatacacatgtgttgtcgatacatcgaagcaataaccctaatgcgatcttttacgactttgggggacaggactattatcatgggatttaccaagccttttttaccacccaatcgttataccttctcttttgggatgctaagaaggatcgaaactttgtgagcgtagatgataaagaatatcagactcttaatttcaatcgcccctattggttaggacagatagcctatgcctgcaatcgttgtatgtccgttggaggaaatcctgatggcaaggacacaccacagaccacagacgatacaattatcattcagactcatgccgatgaaacgggcgctaagcagcaaaccttaggctgtgcagccgagaatggagtattggaagaaatctatgtatccttagagcccaaggcgaatagtgccgtacatgcgctcaactatctgaatgagcgggtgcgagaagttgtcgcaagcaggagtaaatcaattcagatcacagaaaaagataagggattgtacgaagctcttcccacaatcgccggtgataataaacacatccctatctctctcgaagctcttgcggctcaattgaataagggaagagctgaaaatgatctttacaccatagagtatctacagaccgaattgaaccagcttagtctgcgaggggaggtgctttactatcgtgagaatgagaagctgaacaattatgtctggttagatccggcagcttttgtccaaatgattcatggagaaatcctccaaaaagacaacatcaatagaggaacagttcctaaagacatttttgaatgcaaactgcataatctaagttccggaagtatatttgaagaagatggccaaaatggtaatatgatcttgcagctattattggaagagctgatcgtatatgaagataaggactgctatgtgataccgggctatctccctttgcattccgatgacgaagcctataaatggcttactttgggattcgagaggcccaattttgtcctcaaattcgaacgttttatcccctttggcctgatcaaccagattatagcctactatggccgggaagaaggtgctctaaagcggtattggcgagatcaggtcatcttcacagcaggccgtgagatggataggcaaacgcttgagcaagaagaagagaaagagggtttgcccaagacgaatgccgaggattatcagatctggatcaagctcgactttaccgacttggccatatccgtattcatcaaagagcagagaaagacatcagctaaggatatgcagcggaaagaggctactatcctcagtgatatgttggatatgtattggaacaatatccctccgagggagcaaataggagataaggatacggagcaaacgagaagcactattcgtgaaacaaacagaaagaagagacccatccaggatctctacctctcctgtgcccaagcggataaagatttgacggagtctcattatatccatttgggcacgctggacgatgaaagcaagactacggcgaggattgcagcctatccgttgaagaacggcgttatcgataaagagcgggtgcgagaagtatcgactcgtccctacaaacatctttccgtcaataaaaatctggctactgcaaaacagatctttatttcctattccaaagaggatcagactgaactggagacctgtctgcaatttttcaaacccttggagaagaatggtcagatcgagatctactatgataagttgactaagtttgaaacacctattcaccctgaaataagaaagcgtattgtcgaagccgactgtataatcgctttgatcagccaacgctatctggccacggattacatcctggatcatgagttgcctgtatttcgggagtataacaagaccatagtgccgatattgatcaagccttgtacattcgaagacgatgagttccttcgggagaaatattttgctcagaaagctcaaataatcaatcttggaaaagagggaaaaaccattaaagcttatgatagtattacggcatcagcccatcgtgatgaaaattgggtggcagtagtcagagagttcaaagagaagatattaagaataacaaaacaggaggtaaatacagatgaa

SEQ ID NO: 252 - DNA, 3696 bp, Porphyromonas gingivalis
atgacaaccaagaaaccccaagccattttagacttagagaaggcctataacattgaaattcctgatctctcctcacaagaagggataagctggtcggtaaatagatatttcaagcaagattcctccggtgcagtcgttgagctttgcttgcgagaatgtcagatagaaagcatgacttggcttattgattttcctgctctaaaaaagcttgatctatcgtataaccaaatcagtaagctagagggtctagaacgtcttacttcgttaacaaaacttcgtctaagaagtaaccaaatccgtaaactagagggcctggatagtctcacctcgctaacaaaactttctctctccgataaccaaatcagtaagctagagggtctggaacgtctcacctcgttagcggagctttatcttttggataaccaaatcagtaaactagagggtctggaacgtctcacgtccttagcaacgcttgaactatcgggtaaccaaatccgtaagctggagggtctggaacgtctcacgtccttagcaacgcttgaactatcgggtaaccaaatccgtaagctagagggtctggaacgtctcacttcgttaacaaagcttcgtctaagaagtaaccaaatcagtaagctagagggtctggaacgtctcacgtccttagcaacgcttgaactatcgggtaaccaaatccgtaagctggagggtctggaacgtctcacgtccttagcaacgcttgaactgtcgggtaaccaaatcagtaagctagagggtctggaacgtctctcttcgttaacaaagcttcgtctaagaagtaaccagatcagtaaactagagggcctggaacgtctcacctcgctaacaaaactttctctctccgataaccaaatcagtaagctagagggtctggaacgtctcacctcgttagcggagctttatcttttggataaccaaatccgtaagctggagggcctggaacgtctcacctcgttaacaaagcttcgtctaagaagtaaccaaatcagtaaactagagggcctggatagtctcacctcgctaacaaaactttctctctccgataaccaaatcagtaaactagagggcctggaacgtctcacgtccttagcggagctttatcttttggataaccaaatccgtaagctggagggtcttgatggtcttgcttccttaacaaggcttagtctaaggcgcaaccaaatcagtaagctggaaggactagacagactaaaggttttgagaaaacttgatgtttcgggcaatgatattcaatctattgatgatattaagctattggctccgattctggagcaaactttagaaaaactgagaatccatgacaatccatttgttgcatcatcaggcttgatactctctccttatgataatcatttgccggagattaaagctcttcttgaaaaagaaaaagaaaaacagaaaaagacttcagttgaatatcacccattttgcaaagtaatgctattgggaaatcattcttcgggtaaaacaacatttcttagtcaatacgatacaaattatacgtatcagaaaaatacacatgtgttgtcgatacatcgaagcaataaccctaatgcgatcttttacgactttgggggacaggactattatcatgggatttaccaagccttttttaccacccaatcgttataccttctcttttgggatgctaagaaggatcgaaactttgtgagcgtagatgataaagaatatcagactcttaatttcaatcgcccctattggttaggacagatagcctatgcctgcaatcgttgtatgtccgttggaggaaatcctgatggcaaggacacaccacagaccacagacgatacaattatcattcagactcatgccgatgaaacgggcgctaagcagcaaaccttaggctgtgcagccgagaatggagtattggaagaaatctatgtatccttagagcccaaggcgaatagtgccgtacatgcgctcaactatctgaatgagcgggtgcgagaagttgtcgcaagcaggagtaaatcaattcagatcacagaaaaagataagggattgtacgaagctcttcccacaatcgccggtgataataaacacatccctatctctctcgaagctcttgcggctcaattgaataagggaagagctgaaaatgatctttacaccatagagtatctacagaccgaattgaaccagcttagtctgcgaggggaggtgctttactatcgtgagaatgagaagctgaacaattatgtctggttagatccggcagcttttgtccaaatgattcatggagaaatcctccaaaaagacaacatcaatagaggaacagttcctaaagacatttttgaatgcaaactgcataatctaagttccggaagtatatttgaagaagatggccaaaatggtaatatgatcttgcagctattattggaagagctgatcgtatatgaagataaggactgctatgtgataccgggctatctccctttgcattccgatgacgaagcctataaatggcttactttgggattcgagaggcccaattttgtcctcaaattcgaacgttttatcccctttggcctgatcaaccagattatagcctactatggccgggaagaaggtgctctaaagcggtattggcgagatcaggtcatcttcacagcaggccgtgagatggataggcaaacgcttgagcaagaagaagagaaagagggtttgcccaagacgaatgccgaggattatcagatctggatcaagctcgactttaccgacttggccatatccgtattcatcaaagagcagagaaagacatcagctaaggatatgcagcggaaagaggctactatcctcagtgatatgttggatatgtattggaacaatatccctccgagggagcaaataggagataaggatacggagcaaacgagaagcactattcgtgaaacaaacagaaagaagagacccatccaggatctctacctctcctgtgcccaagcggataaagatttgacggagtctcattatatccatttgggcacgctggacgatgaaagcaagactacggcgaggattgcagcctatccgttgaagaacggcgttatcgataaagagcgggtgcgagaagtatcgactcgtccctacaaacatctttccgtcaataaaaatctggctactgcaaaacagatctttatttcctattccaaagaggatcagactgaactggagacctgtctgcaatttttcaaacccttggagaagaatggtcagatcgagatctactatgataagttgactaagtttgaaacacctattcaccctgaaataagaaagcgtattgtcgaagccgactgtataatcgctttgatcagccaacgctatctggccacggattacatcctggatcatgagttgcctgtatttcgggagtataacaagaccatagtgccgatattgatcaagccttgtacattcgaagacgatgagttccttcgggagaaatattttgctcagaaagctcaaataatcaatcttggaaaagagggaaaaaccattaaagcttatgatagtattacggcatcagcccatcgtgatgaaaattgggtggcagtagtcagagagttcaaagagaagatattaagaataacaaaacaggaggtaaatacagatgaa

SEQ ID NO: 253 - DNA, 3525 bp, Porphyromonas gingivalis
atgacttggcttattgattttcctgctctaaaaaagcttgatctatcgtataaccaaatcagtaagctagagggtctagaacgtcttacttcgttaacaaaacttcgtctaagaagtaaccaaatccgtaaactagagggcctggatagtctcacctcgctaacaaaactttctctctccgataaccaaatcagtaagctagagggtctggaacgtctcacctcgttagcggagctttatcttttggataaccaaatcagtaaactagagggtctggaacgtctcacgtccttagcaacgcttgaactatcgggtaaccaaatccgtaagctggagggtctggaacgtctcacgtccttagcaacgcttgaactatcgggtaaccaaatccgtaagctagagggtctggaacgtctcacttcgttaacaaagcttcgtctaagaagtaaccaaatcagtaagctagagggtctggaacgtctcacgtccttagcaacgcttgaactatcgggtaaccaaatccgtaagctggagggtctggaacgtctcacgtccttagcaacgcttgaactgtcgggtaaccaaatcagtaagctagagggtctggaacgtctctcttcgttaacaaagcttcgtctaagaagtaaccagatcagtaaactagagggcctggaacgtctcacctcgctaacaaaactttctctctccgataaccaaatcagtaagctagagggtctggaacgtctcacctcgttagcggagctttatcttttggataaccaaatccgtaagctggagggcctggaacgtctcacctcgttaacaaagcttcgtctaagaagtaaccaaatcagtaaactagagggcctggatagtctcacctcgctaacaaaactttctctctccgataaccaaatcagtaaactagagggcctggaacgtctcacgtccttagcggagctttatcttttggataaccaaatccgtaagctggagggtcttgatggtcttgcttccttaacaaggcttagtctaaggcgcaaccaaatcagtaagctggaaggactagacagactaaaggttttgagaaaacttgatgtttcgggcaatgatattcaatctattgatgatattaagctattggctccgattctggagcaaactttagaaaaactgagaatccatgacaatccatttgttgcatcatcaggcttgatactctctccttatgataatcatttgccggagattaaagctcttcttgaaaaagaaaaagaaaaacagaaaaagacttcagttgaatatcacccattttgcaaagtaatgctattgggaaatcattcttcgggtaaaacaacatttcttagtcaatacgatacaaattatacgtatcagaaaaatacacatgtgttgtcgatacatcgaagcaataaccctaatgcgatcttttacgactttgggggacaggactattatcatgggatttaccaagccttttttaccacccaatcgttataccttctcttttgggatgctaagaaggatcgaaactttgtgagcgtagatgataaagaatatcagactcttaatttcaatcgcccctattggttaggacagatagcctatgcctgcaatcgttgtatgtccgttggaggaaatcctgatggcaaggacacaccacagaccacagacgatacaattatcattcagactcatgccgatgaaacgggcgctaagcagcaaaccttaggctgtgcagccgagaatggagtattggaagaaatctatgtatccttagagcccaaggcgaatagtgccgtacatgcgctcaactatctgaatgagcgggtgcgagaagttgtcgcaagcaggagtaaatcaattcagatcacagaaaaagataagggattgtacgaagctcttcccacaatcgccggtgataataaacacatccctatctctctcgaagctcttgcggctcaattgaataagggaagagctgaaaatgatctttacaccatagagtatctacagaccgaattgaaccagcttagtctgcgaggggaggtgctttactatcgtgagaatgagaagctgaacaattatgtctggttagatccggcagcttttgtccaaatgattcatggagaaatcctccaaaaagacaacatcaatagaggaacagttcctaaagacatttttgaatgcaaactgcataatctaagttccggaagtatatttgaagaagatggccaaaatggtaatatgatcttgcagctattattggaagagctgatcgtatatgaagataaggactgctatgtgataccgggctatctccctttgcattccgatgacgaagcctataaatggcttactttgggattcgagaggcccaattttgtcctcaaattcgaacgttttatcccctttggcctgatcaaccagattatagcctactatggccgggaagaaggtgctctaaagcggtattggcgagatcaggtcatcttcacagcaggccgtgagatggataggcaaacgcttgagcaagaagaagagaaagagggtttgcccaagacgaatgccgaggattatcagatctggatcaagctcgactttaccgacttggccatatccgtattcatcaaagagcagagaaagacatcagctaaggatatgcagcggaaagaggctactatcctcagtgatatgttggatatgtattggaacaatatccctccgagggagcaaataggagataaggatacggagcaaacgagaagcactattcgtgaaacaaacagaaagaagagacccatccaggatctctacctctcctgtgcccaagcggataaagatttgacggagtctcattatatccatttgggcacgctggacgatgaaagcaagactacggcgaggattgcagcctatccgttgaagaacggcgttatcgataaagagcgggtgcgagaagtatcgactcgtccctacaaacatctttccgtcaataaaaatctggctactgcaaaacagatctttatttcctattccaaagaggatcagactgaactggagacctgtctgcaatttttcaaacccttggagaagaatggtcagatcgagatctactatgataagttgactaagtttgaaacacctattcaccctgaaataagaaagcgtattgtcgaagccgactgtataatcgctttgatcagccaacgctatctggccacggattacatcctggatcatgagttgcctgtatttcgggagtataacaagaccatagtgccgatattgatcaagccttgtacattcgaagacgatgagttccttcgggagaaatattttgctcagaaagctcaaataatcaatcttggaaaagagggaaaaaccattaaagcttatgatagtattacggcatcagcccatcgtgatgaaaattgggtggcagtagtcagagagttcaaagagaagatattaagaataacaaaacaggaggtaaatacagatgaa

SEQ ID NO: 254 - DNA, 687 bp, Porphyromonas gingivalis
atgatgaaaaaagcatttgttttcgtactactggtttgcctattctcctcgttcagcagttccgcccaaacaacgacgaacagtagccggagttattttacaggacgaatcgagaaggtgagtttgaacttaggggtcccccccgtaagcacagaggtttggggaatgacccatgatgcgaacggtctccctttcgaaatacctatctctttcagtcgtttcaacagccagggagatatagctaccacttattacatagcgaatagcgaggcaactttgaatgaatggtgcgactatgcacacccgggcggcatcgtgagggtagaaggtcgtttttggaaaatgacttacaacataccaacctacaatgcagtctgcacccggattacattcgaaaatcaagaaatagaaggaacgatcgtcttgatacccaagcccaaagtctcgctgcctcatgtgtcggaatcggtgccttgcatccgaaccgaagccgggagggaatttatcctttgcgaagaagacgacacctttgtgtctcacgatggtaacgaagtaacgataggcggtaaacctttcttgctcaataccaacgtaaagattgtgggggacgtatctcaaaagtatgccgtgggggtaggagaaattcgattcctgcagatttgtgcccaaacagtatcacaacaaaaa

SEQ ID NO: 255 - DNA, 684 bp, Porphyromonas gingivalis
atgaaaaaagcatttgttttcgtactactggtttgcctattctcctcgttcagcagttccgcccaaacaacgacgaacagtagccggagttattttacaggacgaatcgagaaggtgagtttgaacttaggggtcccccccgtaagcacagaggtttggggaatgacccatgatgcgaacggtctccctttcgaaatacctatctctttcagtcgtttcaacagccagggagatatagctaccacttattacatagcgaatagcgaggcaactttgaatgaatggtgcgactatgcacacccgggcggcatcgtgagggtagaaggtcgtttttggaaaatgacttacaacataccaacctacaatgcagtctgcacccggattacattcgaaaatcaagaaatagaaggaacgatcgtcttgatacccaagcccaaagtctcgctgcctcatgtgtcggaatcggtgccttgcatccgaaccgaagccgggagggaatttatcctttgcgaagaagacgacacctttgtgtctcacgatggtaacgaagtaacgataggcggtaaacctttcttgctcaataccaacgtaaagattgtgggggacgtatctcaaaagtatgccgtgggggtaggagaaattcgattcctgcagatttgtgcccaaacagtatcacaacaaaaa

SEQ ID NO: 256 - DNA, 1620 bp, Porphyromonas gingivalis
atgaagacaaaagttttacgcaaattcgtggtggcggctttcgccgtcgcaaccctctgtcctctcgcccaagcgcagacgatgggaggagatgatgtcaaggtggtccagtacaatcaggaaaaactggtacaaacgaggatgagtgtggcggacaacggatggatctatgtaatgacccacagtggatacgacaccggcaatagcaatgtgaagatcttccgctccaaagaccaaggtgccacataccaaaagttgagggattgggatccatcggatgattatcagtttcaagacttcgatatcgtggtaacgggtaagaatgaatccgacatcaagatttggtcggtagagctcatgaataagcccggaggatataagagtagagttgcggtcttcagtcgcgatgccaacgcgcagaatgcgaaactcgtgtataaggaagacttctccaatgtgcagttgtacgatgtggatatagcctccaactatcgttcgccttcttctcttaacaatggtggcaacccttttgctttggctttcgcttacaccggcttcaacaatacgcacaaaataagttttgtggactatgtgttctctctgaatggagggcaaaatttcaataaaaacttactcttcagtcaagatggagagaagaaaattgacaaggtggatctctcattgggtagcacctctgaatccatgggtcacaatgcctggccgctaatgggtgtggtattcgaaatgaataaacaagggggaaaaagcgatatcggtttcttgtcgaactttgtcgacaatgatcccgaatttcagtggtcaggccctataaaagtgagtgaaagcgacatgtcgttcagccccaaaatccaaatgttgctggacgaggataacaatacgatcaatggggagagttgccacaacttcatgattacgtacagcgattatgattctgaatattcggattgggacattcggtatgtatatcccaagaaatcgttcaagtatgaaaaaggaaaaactccgactatggatgatctggtggaagctttccttacagcttcgtaccagagtgagaccaactcggggctggggtatgacaagaacgccaatcactacctgattacatatgccaaaaaagaagagaacggtacgaacacgctgaaataccgctgggccaattatgacaagattcataacaaagatttgtggagcgacacatttacgtatacatcatctgccaatgctctctacacacctcaagtagacatcaatccgaccaagggtctcgtgtgctggtcatgggtggaatatctgccgggcaaacggatcgtttggtctgatacgcagtggacccatgccaacggtgtagaagacatcgtaatgcaagaaggcagcatgaagctctacccgaatccggctcaagaatatgctgtgattagcctgccgacggcagcaaactgcaaggctgttgtttacgatatgcagggcagagtagtcgctgaggcttctttctccggcaacgaatacaggctgaacgtgcagcacttggctaagggtacgtacatactcaaggtcgtatccgatacggagcgtttcgtagagaagctcatcgtggaa

SEQ ID NO: 257 - DNA, 2313 bp, Porphyromonas gingivalis
atgctgacgatccgaaacttcctcctcttttgttgtctgtcgctgatagcgtttgctgccgatgcacaaagctctgtctcttcgggtagacgactgacagaatatgtcaatccctttatcggaacggccaattacggtaccacgaatccgggagcagtattgcccaatgggttgatgagcgttacccctttcaatgtcagcggatcgacagagaatcgcttcgacaaagattcgcgttggtggagtgcgccttattcggccgacaatagttactgcatcggtttcagccatgtgaatctgagtggagtaggctgtcccgaactgagtggaatactgctgatggccacttccggcacattcgatcctgattactgctgctatggctcttcgctcagtcgagaatatgcgcgcccgggagaatacaaggctgtattggacaaatacggtatagatgcagccgtgaccgtaaccgagcggactgctttgaccgaatttgcttttcccgaaggagaaggccatatcctgctgaacctgggacaggccctaagcaatgaatcgggagcctctgttcgattcttaaacgactccacagtcgtcggcagcaggctgatggggacgttctgctacaatccgcaagcagtttttcgtcagtatttcgtacttcaggtgagtcggcgaccgatctctgccggctattggaagaagcagcctcctatgacagtggaagcccaatgggattcgactgcagggaaatataagcagtacgacggctacaagcgtgagatgagcggtgatgacatcggtgtccgattctcgttcaactgcgatcagggggaaaagatctatgtacgatcggccgtttcattcgtcagcgaagccaatgcgctctataatctggaagcggagcaagaagaggtgttcaaaagtgtcggagggaatccggccaaggctttctccgctatacgctctcgcgctatagagcgttgggaggaagccctcggtacggtggaagtggaaggaggcacaccggatgaaaagacgatattctataccgcactctatcacctgctgatacatccgaatatcctacaagatgccaatggagaatatcctatgatgggcagtggcaaaacgggtaatacggctcacgaccgctacaccgtgttctctctttgggacacgtaccgcaatgtacacccgctgctctgcctcctctatccggagaagcagttggatatggtacggacactgatcgacatgtaccgagagagcgggtggctgccgagatgggagctgtacggacaggagaccctgacgatggagggcgacccctcgcttatcgtcatcaatgacacttggcaaaggggccttcgtgctttcgatacggcaacggcctatgaagccatgaaaaaaaatgcttcttcggcaggagcgacccatccgatccgtcctgacaacgacgactatctcaccctcggcttcgtaccgcttcgcgaacagtacgacaattccgtatcgcatgcgctggaatactatctggccgactggaatctgtcccggtttgcccacgcacttgggcataaagaagacgcagctctattcggaaaacgctcgttgggctacagacactattataataaggagtatggtatgctgtgtccattgctgccggatggatcattcctcactcctttcgatcccaaacagggtgaaaacttcgagcctaatcccggtttccacgagggcagtgcttataactatgcctttttcgttccccacgatatacaagggcttgcccggctgatgggaggagcaaaggttttttcggaaaggttgcagaaagtcttcgatgaaggatattatgatccgaccaacgagccggacatcgcctatccttacctcttctcctatttccccaaggaagcatggcgaacgcagaaattgacccgggagttgatagacaaacatttttgcaatgctcctaacggcttgcccggtaatgacgatgccggtacgatgagtgcttggcttgtctattccatgctgggattctaccctgactgtccgggcagccccacctatacactgacctcgccggtattcccccgagttaggattcggctcaatccgcagtattatcctcagggggagttgatcattacgaccaatacagagaatcaaccgacagattccatttacatccatacggtttctcttggcaataaaacacttccgcatggaacaaggcatatcagccatgccgatttggtgcgctgcggtcacctccgttacgaactaagcaatcgtcctcga

SEQ ID NO: 258 - DNA, 2328 bp, Porphyromonas gingivalis
atgtgcaaaataagattcagcctcttgcaggctcttgtcgtctgcttattgttcacctctttttctctccaagctcaagaggaaggtatttggaataccctcttggctatccacaagacggaaaaagccgtagaaacgcccaagaaagtctttgccgtagccaacggagtactttactcggtgggcaaagaagctccccatgaggcaaagatcttcgaccgtatcagcggactcagcgatacatcggtaagcagcatagcctactccgagcaactaaaatccttggtcatatactatgcatcaggcaatatcgacatcttggacgaagcaggccgtgtgaccaacgtacctgcattgaaagacaatatcgatctgatagacaaaacgctcaatcgccttttgatcgtaggcaacagggcttatttggcaggaggattcggcctctccgttctggatgtcgccgaagctcgcataccggctacctacgccaagggaactaaggtgaccgatgtggctaagttggacaatgatcgcttgctgatgctgaaagaagggcagctcttcatcggaaaagagaccgataacctgcaagatccggccgcatggacagccttgtctttgaatttgccgatgggctcggtcaccggtctgggcattgtcggggaagacatctgtttcctgctcgccgatggccgtgtatatgtcgctgcaaaccaatcgtttgagccggagctattgctctcttcctccgccgattcacgactgtatgtgacggatcgtggtctgttcatctgtgccgagaatcgaatttatttcatagaaaaaggtcgcaaaacgacacaatttcctatagccgacgtccttggtgtcggtgccatgaacgaaagcaatacggcatacatagcattgggagaagaaggtttggcttcacttcttctcgcagagggaagtacggccgaagccatgcctgtagcattcgacggaccgggggacaatgatttctacgagatgcggtttagtcacggacgtctgtatgcagccagcggactctggggaacaaacctgatgggacatgccggtatggtgaagctatacgacggcaaccgatggactaacttcgacaagaagaccgtacaggaacagttgggcggcggattcagtttcaatgatgctatcgatatagctgtttccaacggagaccccgatcacttttttgtcggtacatggggaaacggtctgttcgaattcaaggatggcaaagcgatagctcgctattcgggaaacgaaactgctatcgcagaatgtaatcccggagatgcccgtgtgaaagcgattgcctttgacaataagggcaacctctgggggacgctcggtgccgtaggcaagaacatcttcatgtacgatccgcagagtagcacatggcattctttcagctatccggatgtagccaatctggcctccttcggcaatatgattatcctacccaacggagacaaatgggtaaatatccttcaccgtagtggcggatccacgcgcaaaggtgtcttgatcttcaacgatcggggtacaccggaaacgacttcggacgacagccatctttacgtcgagcagtttgtcaatcgcctcggggcagccataggacataagactatctatgcaatggccgtcgatcataacggctctgtctggatgggatcggatataggcattttcggcgtctacaatgcagccggagtattgtcctcgacttctacccctatcgctgttcggccggtcggaggagaagaacccaatttgtactatgtgctggacaaggtgacggtgacagacatcgtcgtggacaaactcaatcacaaatgggttgccacccaagggacaggactctatctcctttcggaagattgcagtaagatcctcgcgcaatttaccgtagaaaacagccctttgctttctaacaacatactatccctggccttaaatgacgataacggactgctgtacatcggtacggcggacggactgatgacgttccaaacgggtacggggagtggatcagcttccgaactggacggcgtctatgtataccccaatccgctaaggccggaatatcccgatggcgtcaccattgccggactgcaagccggctgtagtgtcaaaatcaccgataccaccggcagactgctataccagactgagagcgtaaccaccgaagtcaaatggaatgctcgaggtgccgatggcaatagggtagcttcgggcgtatatgccgttgcagtgtacgatccggtatcgaaaaagtccaaactaattcgcttcgcagtgattcgc

SEQ ID NO: 259 - DNA, 3474 bp, Porphyromonas gingivalis
atgaaacgaatacttccaatagtcgcattcctttctctcttccttgcccttgctttgcctgcgaaagcgcaacgagctatggggaagacggccgaccgttcgctaatggcttcgggacattgggtcaagatacgtgtcgatgcaagtggagtgtatcgccttacggacgaacagctccgtgccaatggcttctccgatccgtccaaggtaggtgtgttcggttatggtggaggggtgcttcccgaagatctgagccggatcacgacagacgatttgcctccggtaccggtactccgtcagggcaatgcgctgtatttctatgccgtgggcccggtgacatggttctacaatccggccaaaaccaccatggagcatacggtgaatacatacagtacgcatggctactacttcctgtcggatgctgccggagcacctttgcagatgtcccaatatacgggtggaggtgcgtcggccgaggctttgatcgactactacgatgagctgatgctccatgaacaggaattgtattcgcccaaagaatcgggacgagatctgtatggcgagtctttcagtgcagtcaatacgcgtacggtcaagttccctttgaggggcaacacccgctcgtctggcgaactcggtaccgtattctcatacatagccaaggccagatcggccggtggcggccgtgagatgtcgctctcggcgaatggcattctgatcttcagcgatcctttttccatgacatcgaatgaagtctccaattcctatttggccggcaagaagcgtcgtctctatcacagtacgccgatgaacagcttggtcaatgagttgcgcttggacgcgaactatagcatgacaggagatgcggtcaatctggatttcatagaggtggctacacagaacgacctccggtacgatggcgcacccatgcatatcaggcggttttccaatttgcccgttttggggggcgagtcctgccggttcgttatcagtgaggtgccggagtctctggtggttttgcaggccaattcttccctgacagcatcgcttgttcccgttaagactgtcggggataagaccattgagttcgtggctccgccgaagggtcaggatcgtaggactatcaatacgttttatgccgtggacttgtcacaggcttctgctccggagatcctcggagcggtacccaatcaaaacctgcatggagaggaaatccctgatctgatcattgtctctactcaggcgctcctccttgaggctgatcgactggccacctatcgtagagagaaaaacgggctgaaggttttggtcgtgttgcaggaacaggtgttcaacgagttttcgggtggaactcccgatgctacagcataccgcctctttgccaaaatgttctacgacagatggaaggcaaatgcacctgtgggagagaccttcccgatgcaaatgcttctcttcggtgatggggctcatgacaacaggaaggtctccgtagcttggcagaaaccgtatctccaacaaacggagttcttgctgacattccaagccgtcaattcgacgaacgtaaacagttatgtgacggatgattacttcggcttgctggatgatcagccggcctcggtcaatatcggttggcgcaattataatatggctgtagggcgattccccgtacgtactccggccgaagctcgcatcgcagtggacaagaccatccgatatgaggaggatcgagagagtggtgcctggcgtattcgtgcctgttttgcggcagacaacggggacaagcacgcaaccgagacttcccgtttgatcgataccgtcaagcgttatgctcctgccatcatgccggtacgcgcctttcaggacgtatatccgcatgtcatcgagaacgggttgcacagcattccgggtgcaaagaaaaagatgctggaaacccttcagtcgggtattatcctgcttaattatgctggtcatggcggtcctgccggatggtcggacgagcatttgctgacgctcaacgatatacacaaattcaattataagcatatgcccatttggattactgccacgtgcgactttgccaactatgacagtcagacgacctcggcaggggaggaggttttcctccatgagaagagtggcactccgatcatgttctcgactacgcgtgtcgtttacaatacgcagaatgagaagatcaatggttttatgcttcggcgtatgttcgagaaagctaaggatgggcgttatcgtacgatgggcgagattatccgatcggccaaacaggggatgctcagtactgttttccccgattcgatcaaccagttgagtttctttctgatgggtgatccgtccgtgcgtatgaatcttcctacccacaaagtgcaattgaccgcaatcaacgggcaggatcccgaagggcagtatggaactattatgctcaagtctttggaacgggtagctctgaagggtaaggtaaccgatgaaaaggggacattcgacgagacattcagtggcaaggttttcctgaccgtcttcgatggcagaaagaaaatgacagctttggaagaggagggaaacgatctctctcttgtatattatgactatcctaacgtgatgtatgccggtattgccgaggtgaaagacggactcttcgaaacttcgtttatcgtacccaaggatgtgaactattccgagcacgaaggccggatcaatctttatgcttataacgagagcacaaaggcggaagccatgggggtagacttctccatcagagtccaaccgggtattcctgatgaggtaacggaagataatacaccgcctgaaatcataagctgcttcctcaatgacagtacattccgatcgggagatgaggttaatcctactcctctgtttatggccgaagtattcgacttgaatggaatcaatatcacgggtagcggagtagggcatgatattacgctttgtatcgatggccgtgccgacctgacctacaacctcaatgcatatttcacaagttcggctacggatgcaggtgtgggcactattctcttcatgataccggctttggccgaaggagatcatactgcccgactgacggtttgggacattttcaataatgccgtccatcatgacttttcattcagagtggtagatggcattgctccggatgtggctgatgtgattctattcccgaatccggtacgcgagagtgctacgttccgaatcttccacaatcgccccggaagcgatttgaacgtggccgtggagatctatgacttcaccggtcgtcttgtgaacagtttgccagtcaagacctattcgtcttcctacggagaacctatagagatcaagtgggatctgacctccaaatacggagtgaagatcggaaacggattctacctctatcgttgtgtggtgaactctcccggaggacagacggcctccatggccaagaaaatgatcgtggtaggacaa

SEQ ID NO: 260 - DNA, 2883 bp, Porphyromonas gingivalis
atgaagaaacttttcccattattattactcatattgtcgattttggtcggatgtggaaaaaaagaaaaacactctgtaactgaaatcgcccgagagaaaaagcgtattactgcattgctgtacgaaaaagaactccccactgattctgttaaacagctttacgagaacagcgtacagaacaagaaccttgtgggacaaatgttattcgcgatcgaggtcggcaaacggatgcgtaatatgtcccaatacacagatgcgatgctatatcaccaaaaagggttgaacgctgcattgaatctaagggacaccatcgtagccgcacaagcatggaatcatctcggaacggatagccgtcgtatcggtgctttggcagaagcttcggattatcattacaaggctctttccttgatagaatcttttagcggaaaccagaataggcctgcgatcaaagccagatcggcggccctgaacggcatcggcaacatcaatcttgagttaggataccatgatgaggccgaaaagaatttcctgaaagcactgcaaggtgagaaagaactcgacagtcctctcgggcaagctatcaactatgcgaacctcggacgtatctatcgacaacgcaaagaatacgacaaggctcgtacctacttcctcttgtctctggagcagaacaatatggcagagaatctgatgggtatcggactctgtagcatcaatctcggagaagtagacgaagaaaaaggggattatcaaaaggctttgcaagagtatgccacggcatacaaactgatggaacagttgtccgatcgatggcactggctgaattcctgtatcccgatggcacgtatcaatctcaaacaaggtaacgaaaggctctaccagcatttcatttctttggccgaagggactgcgaaagaaattaattcgacttcacatctgatagaaatatacaatcttcaatacgagaatctcgagcgtaaaaaagaatacaaacaagccctcgaagcattctgtctgagcaagacgttgagcgacagcatgtccattgcgcacaaggtcagcagcatacaagaaacgcgattcaactacgaacgaaacaagtcccaaaaagagcttgaagaaatacagcaagtaagcaaggcaaaacaagagaaatcgaagtttatcctcttgagcactctttttgcccttttcatctcgattcttttgatttctgttctgacatatgcataccgtcagggcaagaagcataacaagctgatcaaagagacggataaacttcgctccggctttttcaccggtattacacacgaatttcgtacgcctatcaccgtcatacaaggtttgaatgagaaaatgagttcaagtcctgatctccaagcatcggacagaaccgagctgcacaagataatagacagacagagtagccatatgctgaatttggtgaaccagctgttggatatttgcaagatcagaagcggagtatccacgcccgaatggcgcaatggcgacatcgtctccttcgtacagattctcatcgattcgtttgcaccatacgcacaggctcaagacataaccttggagctacaacccgagagcaaacctattgtcgtggacttcgtcccctcctacttgcaaaaaatcatatccaatcttttgtccaatgccatcaagtattctttagccggagggagagtggtcatatctctggcaaaaaccaagaatgaaaaaaatctgatcatacgcgttgcagacaatggcataggaatagataaaactgatcaggctcatatcttcgacatcttctatcgaggacagtccgctaccgaaaagcatggatcaggcgtcggactctcgtttaccaatatactggtcgaaaaccttcgaggtacgatcaaagtggaaagccagccggggaaaggaagtgccttcaccatcagtattcctacacaaaaccagtcctcttcggcagagattcttccttggctaccctcctccgatgacattgtcatgcctgtccacatcgcgcccgatgactcaccgacatctccgatggtagcagctctgaatcatcgcttcgaggacgaacgtccgaccatactgctcgtcgaggacaataaggatatcaacctgctcgtcaaactactcctttgcgatcgctacaatgtgctatccgccgcaaacggaaaagagggtatagccctcgctaccgagcatattcccgacattatcattacggatattatgatgccgataatggatgggatagaaatgacaatccggatgaagcaatcgcctctgctctgtcacattcccattgtcgctttgacggccaagagtaccgaacaggacagattggaaggaatcaaaagcggtgtagtctcttatctatgcaagccattctctccggaggagcttttgatgcggatcgagcagcttctgaaagaccgtgagttgctcaagaagttctatatgcaaaaactcatgctggatcggaagccggaggaggagcctcaaccgatagatgacagcagtatgcagtttctccttgctgccaaagatgcagtgtccggtggaatcaaacaaaatccggatttttccgctcaagacttggccgaaaaaatgtgcatgagtccatcccaactcaacagaaagctcacgagtgtcgtaggttgctccaccatcggctacatacagcagatcaagataaaattggcctgcaagctccttgccgatgagagcaaaaacatctccgacattagcattgaggcaggcttttcggatccggcttacttctctcgcaccttcaaacgctacatgaactgctctccctcccaatatcggcaaaaactccttgccatgccggggagcgacaaggagacagtt

SEQ ID NO: 261 - DNA, 1668 bp, Porphyromonas gingivalis
atgaaaaagcttttacaggctaaagccttgattctggcattgggactcttccaactgcccgcaatcgcccaaacgcaaatgcaagcagaccgaacaaacggtcaatttgcaacagaagagatgcaacgagcattccaggaaacgaatccccctgcaggtcctgtgcgtgctatcgctgagtacgaacgctctgcagccgttttggtacgctacccgttcggtatcccgatggaattgatcaaagagctggccaagaacgacaaggtgattaccattgtggcgagtgaaagccaaaaaaacaccgttataacccagtacacccaaagcggtgtgaatctctctaattgcgatttcatcattgcgaaaactgactcttactggacacgcgactataccggttggttcgcaatgtacgatacgaacaaagtaggtctcgtggactttatttataaccgccctcgtcctaacgatgatgaattccccaaatacgaagcacaatatctgggcatcgagatgttcgggatgaagctcaagcagaccggtggcaactacatgacggacggatatggatccgctgtgcagtcacatatcgcatatacggagaactcctctctgtctcaagctcaagtaaatcaaaagatgaaagactatctcggcatcacacatcatgatgtggtacaagatccgaacggcgaatatatcaaccatgtggactgttggggcaagtatttggcaccgaacaaaatcctcatcaggaaagtgcctgacaatcaccctcagcaccaagccctggaagatatggcagcctacttcgcagcacagacctgcgcatggggaacgaagtacgaggtatatcgcgctttggccaccaatgaacaaccgtacacgaactctctgattctgaacaacagggtatttgttcctgtcaatggccccgcctccgtggacaacgatgctctgaacgtctataagacggcaatgcccggttacgaaattataggtgtcaaaggggcttcaggaacaccttggttaggaacagatgccctgcattgtcgtactcacgaggtagcggataagggctatctctatatcaagcactacccgatactgggcgaacaggcaggccctgattataagatcgaagcagatgtcgtctcatgcgccaatgctactatctcgccggtacaatgttactatcgtatcaatggttccggtagctttaaggctgctgatatgacgatggaatcaacaggtcactatacttatagctttacaggtcttaacaagaatgataaggtagaatactatatctctgccgctgacaatagtggtcgcaaagagacttatccctttatcggcgaacctgatcctttcaagtttacgtgtatgaacgaaaccaatacatgtactgtgaccggagctgccaaagctcttcgtgcatggttcaacgccggtcgttcagaactggctgtttcggtaagtttgaatattgccggcacatatcggataaagctttataacaccgcaggagaagaagtcgctgcaatgaccaaggaattagtagcagggacgagtgtcttcagtatggatgtgtattctcaggctccgggcacatatgttctggttgttgaaggaaatggaatccgtgagacaatgaaaattctcaaa

SEQ ID NO: 262 - DNA, 1284 bp, Porphyromonas gingivalis
atgaaactttcatctaagaaaatcttagcaatcattgcattgctgacgatgggacatgctgtgcaggcacagtttgttccggctcccaccacagggattcgcatgtctgtcactacaaccaaggccgtaggcgaaaaaatcgaattgttggttcattccatagagaagaaaggcatctggatcgatctcaatggggatgccacttaccaacaaggagaggaaataaccgtattcgatgaggcataccacgaatacacgatcgggacgcaaaccctcactatctatggtaatacgacccgattgggctgtcgatctaccggtgcaacggctgtcgatgtaacgaaaaaccctaatctgacctatctcgcatgcccgaaaaataatctgaaatcattggacttgacgcaaaacccaaagctgctgcgagtttggtgcgactctaacgaaatagaaagtttggacctgagtggcaatccggctttgatcatcctcggctgtgacaggaataagctgactgagctgaagaccgataacaaccccaagttggcctctctttggtgttctgataataacctgacggagttggaactcagtgccaatcctcgtctcaatgatctttggtgcttcggtaatcggatcacgaaactcgatctgagtgccaatcctctattggtaacactttggtgcagtgacaatgagctttcgaccttggatctttccaagaattcggacgttgcttacctttggtgttcatcgaacaaacttacatccttgaatctgtcgggggtgaagggactgagtgttttggtttgtcattccaatcagatcgcaggtgaagaaatgacgaaagtggtgaatgctttgcccacactatctcccggcgcaggcgctcagagcaagttcgtcgttgtagacctcaaggacactgatgagaagaatatctgtaccgtaaaggatgtggaaaaagctaaaagtaagaactggcgagtatttgacttcaacggtgattctgacaatatgcttccatacgaaggaagtccgacatcgaacttggcagtagatgctcccactgtcaggatatatcccaatccggtaggaagatatgcgctcgtcgagatccccgagtctcttttagggcaggaagctgctttatacgatatgaatggggtaaaagtctatagtttcgcggtagagtctcttcgtcagaacattgacctgacacatcttcccgacggcacttatttcttccgtctcgataactataccactaagctcatcaaacag

SEQ ID NO: 263 - DNA, 930 bp, Porphyromonas gingivalis
atgagaaaaacaataattttctgcttgttgctcgccctatttggctgttcttgggcacaagaaagagtcgatgaaaaagtattctccgcaggaacaagtatttttaggggcatccttgaaaaggtgaaagcaccgcttatgtatggagatcgtgaggtatggggtatggctcgtgcgagcgaggatttcttttttatacttcccgttacggatgacctcactcccgtgcttttctataaccgtcttacaaacgaaccctgctttgtgtcagaccaaggaataactgagtatttcaaattcgctcaagaaggtgattacattgaagtcgaaggaagctctgtattcatggcgaatcttttgtactatcgttttttcccgacaagaattacctcctataatgctcccattgaaggtgttgtgagcaagacgggaaatcctgcttttacaatcccgatgctcccgggggtttctgattgcatagaaatctcaaacaaccgcaaagtctttctgaccaatcaattaggggttgtaaacatcactgacgggatggaacctccgattattgccggagtctctgcttcctatggatcttccgtccgggtgtatggtcatgtctcacagcggtgggacatcataggccattgctatttggatatctacccaaccaattgctatccgctcagcacgaaacccgttgcaggagacgatgaggtttttgtcaaacaacaaggcaggcaaatagagatcgatagcaacagccccatagtccaagtggtcgtatacgatcttgaggggaaaagtgtttttcgcaaaagaatgaccgaaaacgcttataccctatcctttagagcacccatgctcggctttatgaccatcatgatcgaaacacaaaattcgattatcaataaaaaacttaatgttacacagcta

SEQ ID NO: 264 - DNA, 1215 bp, Porphyromonas gingivalis
atgaaaaaaacaaccattatttctttgattgtcttcggtgctttctttgcagccgtgggccaaaccaaggacaattcttcttacaaacctttttcgaaagaagatattgccggaggagtttactctctcccgactcaaaatcgtgcgcagaaggacaatgccgagtggcttcttacagcgaccgtctccacaaaccagtctgcagatactcactttatcttcgatgagaacaaccgctatatcgctcgtgacataaaagccaatggggtaagaaaatccacggactccatttactacgatgccaacgggcgaatatcgcatgtggatctttatatctcgttcagtggcggagagcctgcactcgacacccgattcaagtacacctatgatgacgagggaaagatgaccgtgagggaagtattcatgctggtaatggatccgaatacacctatctcacgcttggaatatcattatgatgcacagggcagactgacccactggatttcttttgctttcggggcagaatcccaaaagaatacgtatcactataatgaaaaaggtctgttggtcagcgaagtgctgagcaatgcaatggggacaacctattcagacaccggcaaaacggaatacagctatgacgatgcagataatatggtgaaggccgagtacttcgtcgtccagcaaggaaaggcatggcaagtactcaaaagagaggaatacacctatgaggacaatatctgcatacaatatttggctattaacggtaccgacacaaaggtgtacaagcgagacatcgagagcgataagtccatctccgcaaatgtcattgacattccgtcaatgccggaacagacctggcctaatatgtacggattcaacgcaaagcgactgaaagagacttattcctcctacgaaggagatgtggctactcctatattcgactatatctatacgtacaaggctcttacctcaatggcaacaccttcgacagaagctcaggtagcagtctatctcaatccgtcaacggaccggttagtgattctggccaacggcatcacacatctgagcatgtacgacttgcagggtaagcttatccgtgattgtgccttgagcggcgataaggtggaaatgggtgtcggatctttgaccaaagggacatacctgcttaaagtgaatacggatcagggagcctttgtgagaaaagtcgtgattcga

SEQ ID NO: 265 - protein, 454 aa, Poryphyromonas gingivalis
FCVMAKVIKTKKGLALNLKGKPLPEMLAEPAQSPTYAVVPDDFEGVIPKVTARPGDKVRAGSALMHHKAYPEMKFTSPVSGEVIAVNRGAKRKVLSIEVKPDGLNEYESFPVGDPSALSAEQIKELLLSSGMWGFIKQRPYDIVATPDIAPRDIYITANFTAPLAPDFDFIVRGEERALQTAIDALAKLTTGKVYVGLKPGSSLGLHNAEIVEVHGPHPAGNVGVLINHTKPINRGETVWTLKATDLIVIGRFLLTGKADFTRMIAMTGSDAAAHGYVRIMPGCNVFASFPGRLTIKESHERVIDGNVLTGKKLCEKEPFLSARCDQITVIPEGDDVDELFGWAAPRLDQYSMSRAYFSWLQGKNKEYVLDARIKGGERAMIMSNEYDRVFPMDIYPEYLLKAIIAFDIDKMEDLGIYEVAPEDFATCEFVDTSKIELQRIVREGLDMLYKEMN

SEQ ID NO: 266 - protein, 201 aa, Porphyromonas gingivalis
ELSKCYMDKVSYALGLSIGNNFKSSGIDSVVMDDFMQGLSDVLEEKAPQLSYDEAKREIEAYFMDLQQKAVKLNKEAGEEFLKINAHKEGVTTLPSGLQYEVIKMGEGPKPTLSDTVTCHYHGTLINGIVFDSSMDRGEPASFPLRGVIAGWTEILQLMPVGSKWKVTIPSDLAYGDRGAGEHIKPGSTLIFIIELLSINK

SEQ ID NO: 267 - protein, 279 aa, Porphyromonas gingivalis
QKNKRKMKKALLIGAALLGAVSFASAQSLSTIKVQNNSVQQPREEATIQVCGELAEQVDCIGTGNSAIIAAAAKFESDDLESYVGWEIMSVDFFPGYKACKYTSAVWADDMTILGQSEDSDPEMQTINNLALKTSVKIEAGKNYIVGYIANTAGGHPIGCDQGPAVDGYGDLVSISEDGGATFPPFESLHQAVPTLNYNIYVVVHLKKGEGVEAVLTNDKANAYVQNGVIYVAGANGRQVSLFDMNGKVVYTGVSETIAAPQKGMYILRVGAKSIKLAI

SEQ ID NO: 268 - protein, 157 aa, Porphyromonas gingivalis
  MOD_RES (2)..(2): Xaa can be any naturally occurring amino acid
RXFLPEKALYIGCRVETQEGHAVGFGLDDGPAMKGKGDLVGSYLPGAAPMPFVPLSDIPARSMDANFYIYSRISLGSGTQDVLQHRMKVYPNPATTELHVEALSAWVGEQAAVYDMRGRRVSARTVDSEKLCIDIASLPVGVYMLRIGSYSAKFEKR

SEQ ID NO: 269 - protein, 562 aa, Porphyromonas gingivalis
TRNVSLIKMPRIMKLKIALRLLLATFAIVLFSPLAKAQMDIGGDDVLIETMSTLSGYSEDFYYKMAVADNGWIYVMLDFSRIYFDDVRLYRSKDGGATYQKLGSLGSLVPYDFDVSHCDFIVTGKDEDDINVWTVMTAFEYVGGTIGNGVLLMHRHDADINNTECVYKKDFPNNRLMGVAIASNYRAPSPYGLGGDPFALAVAVSGSGSDHSFLDYIFSLDGGVHFEQKRIYTRPQKLTINRVDLSLGSTSPSLGFNTWPLMGVVFEMNKNLDGFDIGFISNFVDYDPRYAWSEPIIIEEDCGWTDFNPLGALSIEIQMMLDDNSDNTVGGERSHNFLITYPGHYVYPKQSFNYSPGHTPTKKDLVFKHCIGIPALAYDKEGDRYLTTFQDHNLMRYRWIKYDDINSFYGWSWPYVYAKEAKDKKRRRPQVALNPTNGKACWVWHTRKSPYDETKPHPTPVIIKHFLWSDTEWVHALDVGDVLQKEGSMKLYPNPAKEYVLINLPKEGGHEAVVYDMQGRIVEKVSFSGKEYKLNVQYLSKGTYMLKVVADTEYFVEKIIVE

SEQ ID NO: 270 - protein, 391 aa, Porphyromonas gingivalis
QMKRLLPFLLLAGLVAVGNVSAQSPRIPQVDVHTRIARNARYRLDKISVPDSRQIFDYFYKEETIPTKIQTTTGGAITSIDSLFYEDDRLVQVRYFDNNLELKQAEKYVYDGSKLVLREIRKSPTDETPIKKVSYHYLCGSDMPFEITTEMSDGYFESHTLNYLNGKIARIDIMTQQNPSAELIETGRMVYEFDANNDAVLLRDSVFLPLQNKWVEMFTHRYTYDNKHNCIRWEQDEFGTLTLANNFEYDTTIPLSSVLFPTHEEFFRPLLPNFMKHMRTKQTYFNNSGEGLSEVCDYNYFYTDMQGNALTDVAVNESIKIYPRPATDFLRIEGSQLLRLSLFDMNGKLIRATELTGDLAIIGVASLPRGTYIAEITAANSKTIRAKVSLR

SEQ ID NO: 271 - protein, 428 aa, Porphyromonas gingivalis
KRNPLPLTASNRKIFIKMRQHLSLFPFILFLLLAFSYVGCRTVRQTPKQSERYVVVLSLDGFRPDYTDRARTPALDRMAQEGLSGSLQPCFPSLTFPNHYSMATGLYPDHHGIVANEFVDSLLGIFRISDRKAVETPGFWGGEPVWNTAARQGIRTGVYFWVGSETAVNGNRPWRWKKFSSTVPFRDRADSVIAWLGLPEKERPRLLMWYIEEPDMIGHSQTPESPLTLAMVERLDSVVGYFRKRLDSLPIAAQTDFIIVSDHGMATYENEKCVNLSHYLPADSFLYMATGAFTHLYPKPSYTERAYEILRAIPHISVYRKGEVPKRLRCGTNPRLGELVVIPDIGSTVFFAINEDVRPGAAHGYDNQAPEMRALLRAVGPDFRPGSRVENLPNITIYPLICRLLGIEPAPNDADETLLNGLIRDKRP

SEQ ID NO: 272 - protein, 282 aa, Porphyromonas gingivalis
LSRGVFPLMYGRRGSIRASSGHRDKIFKNTIIRFITMKVGLFIPCYVNAVYPEVGIATYKLLKSLDIDVDYPMDQTCCGQPMANAGFEQKAQKLALRFEELFESYDVVVGPSASCVAFVKENYDHILRPTGHVCKSAAKVRDICEFLHDDLKITSLPSRFAHKVSLHNSCHGVRELHLSTPSEVHRPYHNKVRRLLEMVQGIEVFEPKRIDECCGFGGMYSVEEPEVSTCMGHDKVLDHISTGAEYITGPDSSCLMHMQGVIDREKLPIKTIHAVEILAANL

SEQ ID NO: 273 - protein, 251 aa, Porphyromonas gingivalis
PLKKRMDIVSMADKALVVEMRDVTLCQEENVIFQNLNLTLSAGDFVYLIGSVGSGKSTLLKALYAEVPISAGYARVIDYDLAKLKRKQLPYLRRNLGIVFQDFQLLNGRTVAENLDFVLRATDWKNRADREQRIEEVLTRVGMSRKAYKRPHELSGGEQQRVGIARALLAKPALILADEPTGNLDSVTGLQIASLLYEISKQGTAVLMSTHNSSLLSHLPARTLAVRKNGDASSLVELSADAVSRKNTEID

SEQ ID NO: 274 - protein, 238 aa, Porphyromonas gingivalis
TRHCPACRSSFHLIKTSKTMIEISNLTKVFRTEEIETVALDGVSLKVDKGEFIAIMGPSGCGKSTLLNILGLLDNPTSGIYKLDGAEVGNLREKDRTAVRKGNIGFVFQSFNLIEEMTVSENVELPLVYLGVKASERKERVEEALRKMSISHRAGHFPNQLSGGQQQRVAIARAVVANPKLILADEPTGNLDSKNGADVMELLRGLNREGATIVMVTHSEHDARSAGRIINLFDGKIR

SEQ ID NO: 275 - protein, 604 aa, Porphyromonas gingivalis
  MOD_RES (67)..(67): Xaa can be any naturally occurring amino acid
STETNSKSEMKEFFKMFFASILGVITAGIILFCIFLFIFFGIVAGIASKATGGTIPKIEANSILHIXNSSFPEIVSANPWSMLTGKDESVSLSQAVEAIGQAKNNPNITGIFLDLDNLSVGMASAEELRRALQDFKMSGKFVVSYADRYTQKGYYLSSIADKLYLNPKGMLGLIGIATQTMFYKDALDKFGVKMEIFKVGTYKAAVEPFMLNRMSDANREQITTYINGLWDKITSDIAESRKTAMDSVKMFADKGEMFGLAEKAVEMKLVDELAYRTDVEKELKKMSQRGEKDELRFVSLSQVLANGPMNKTKGSRIAVLFAEGEITEEIIKKPFDTDGSSITQELAKEIKAAADDDDIKAVVLRVNSPGGSAFTSEQIWKQVADLKAKKPIVVSMGDVAASGGYYIACAANSIVAEHTTLTGSIGIFGMFPNFAGVAKKIGVNMDVVQTSKYADLGNTFAPMTVEDRALIQRYIEQGYDLFLTRVSEGRNRTKAQIDSIAQGRVWLGDKALALGLVDELGGLDTAIKRAAKLAQLGGNYSIEYGKTKRNFFEELLSSSAADMKSAILSTILSDPEIEVLRELRSMPPRPSGIQARLPYYFMPY

SEQ ID NO: 276 - protein, 324 aa, Porphyromonas gingivalis
LTLFCCNYFKQMRANIWQILSVSVLFFFGTAIGQAQSRNRTYEAYVKQYADEAIRQMSRYNIPASITIAQALVETGAGASTLASVHNNHFGIKCHKSWTGKRTYRTDDAPNECFRSYSAARESYEDHSRFLLQPRYRPLFKLDREDYRGWATGLQRCGYATNRGYANLLIKMVELYELYALDREKYPSWFHKSYPGSNKKSHQTTKQKQSGLKHEAYFSYGLLYIIAKQGDTFDSLAEEFDMRASKLAKYNDAPVDFPIEKGDVIYLEKKHACSISKHTQHVVRVGDSMHSISQRYGIRMKNLYKLNDKDGEYIPQEGDILRLR

SEQ ID NO: 277 - protein, 533 aa, Porphyromonas gingivalis
RIPDEQTGRIMDGRRYSDGLHQAIEAKEHVKVEAATQTFATITLQNYFRMYHKLAGMTGTAETEAGELWDIYKLDVVVIPTNKPIARKDMNDRIYKTAREKYAAVIEEIVRLVEEGRPVLVGTTSVEISELLSRMLRLRGIQHNVLNAKLHQKEAEIVAQAGQKGTVTIATNMAGRGTDIKLSAEVKKAGGLAIIGTERHESRRVDRQLRGRSGRQGDPGSSIFYVSLEDHLMRLFATEKIASLMDRLGFKEGEVLENNMLSKSVERAQKKVEENNFGIRKHLLEYDDVMNSQREVIYTRRRHALMGERIGMDVLNTIYDVCKALIDNYAEANDFEGFKEDLMRALAIESPITQEIFRGKKAEELTDMLFDEAYKSFQRKMDLIAEVAHPVVHQVFETQAAVYERILIPITDGKRVYNIGCNLREADETQGKSIIKEFEKAIVLHTIDESWKEHLREMDELRNSVQNASYENKDPLLIYKLESYELFRKMVEAMNRKTVAILMRARIPVPEAPSQEELEHRRQIEIRHATQQR

SEQ ID NO: 278 - protein, 720 aa, Porphyromonas gingivalis
KSCRVIGQTRRYGCCPVGLRPCHQSLSGVCRCLFQSRPAVAFARKGQRRHRRSESGRRIRALQGVQHHQTNEHEVMISVNNLTVDFGTRLLFDQVSFVINRRDRIALVGKNGAGKSTLLKLIAGMEEPTSGHIARPKGIRIGYLPQVMRLQDGHTVYEEVEQAFNDIRQIEEEIRRLSDEMAGRTDYESDDYIRLIEHYTNMSETLSLMQQGNYHAAIEQTLIGLGFGREDFHRPTADFSGGWRMRIELAKLLLQRPEVLLLDEPTNHLDIESIGWLEQFIATNAGAVILVSHDRAFIDNTTTRTIEIELGHIYDYKTNYSHYVELREERLRQQMRAYENQQKMIRDTEDFIERFRYKATKSVQVQSRIKQLEKVERVEIDERDRSAFHFRFIPAQPSGSYPLIVDDLAKAYGDHQVFSGATYTIERGEKVAFVGKNGAGKSTMVKCIMGELTDYTGKLELGHNVQLGYFAQNEAQELRGDLTVFDTIDREAVGDIRLRLNDLLGAFLFGGEASEKKVSVLSGGERARLAIIRLLLQPANFLILDEPTNHLDMRSKDVLKEAIKNFDGTVIVVSHDREFLDGLVSKVYEFADGQVNEHLGGIYDYLRTRRMQTLTELERTTTIETKTTREAIPETEAKADYRRQKEVAKQLRTLERTVATCEERIGKLESELQAIEMLLQDPKHATDANLFERYAGMKQELEKAMEDWEQASEALSEAQG

SEQ ID NO: 279 - protein, 386 aa, Porphyromonas gingivalis
YLKLLILQIALMNFLKKEPFKIFSMIYLLLDTITNRAGTERAVINLANNLHANGHRVSLVSVCTKEGEPSFQVEKGIEVHHLGIRLYGNALARKTVYFKAYRRIKALYKKREPVLLIGTNIFINTILSQISNRGRIFTIGCEHISYDIARPITKRIRGFLYSGLDAVVALTKRDQQSFEAILRGRSKAYVIPNQVSFTTVQRDATTHKQMLAIGRLTYQKGFEFMIEDASRVLRERPDWKLIIVGDGENESMLRKEIASRNMESQIEIHPSTPEIRKYYESSAIYLMTSRFEGLPMVLLEAEAYALPIISYDCPTGPRELIENGRNGFLVPMEAHEDFADKLRLLMDDETLRKKMGQESELMVKSYSPANIYECWKKLFVEIGYMN

SEQ ID NO: 280 - protein, 655 aa, Porphyromonas gingivalis
TTKENETTTKNEYRIMGKIIGIDLGTTNSCVSVLEGNEPIVITNSEGKRTTPSVVAFVDGGERKVGDPAKRQAITNPTKTIYSIKRFMGETYDQVSREVERVPFKVVRGDNNTPRVDIDGRLYTPQEISAMILQKMKKTAEDYLGQEVTEAVITVPAYFNDAQRQATKEAGEIAGLKVRRIVNEPTAASLAYGLDKSNKDMKIAVFDLGGGTFDISILELGDGVFEVKSTNGDTHLGGDDFDHVIIDWLAEEFKSQEGVDLRQDPMAMQRLKEAAEKAKIELSSTSSTEINLPYIMPVNGIPKHLVMTLTRAKFEQLADRLIQACVAPCETALKDAGMSRGDIDEVILVGGSTRIPAIQEIVEKIFGKAPSKGVNPDEVVAVGAAIQGGVLTGEVKDVLLLDVTPLSLGIETMGGVMTRLIDANTTIPTKKSEIFTTAVDNQPSVEIHVLQGERSLAKDNKSIGRFNLDGIAPAPRQTPQIEVTFDIDANGILNVTAHDKATGKKQNIRIEASSGLSDDEIKRMKEEAQANAEADKKEKERIDKINQADSMIFQTEKQLKELGDKFPADKKAPIDTALDKLKEAHKAQDVAAIDTAMAELQTALSAAGEELYKNAGAAQGGAQPGPDFGGAQGPSAGDQPSDDKNVTDVDFEEVK

SEQ ID NO: 281 - protein, 467 aa, Porphyromonas gingivalis
KWARTTTLRISNATIYKTMRYDLAIIGGGPAGYTAAERAAKGGLKTLLIEKNALGGVCLNEGCIPTKTLLYSAKVLHQIATASKYAVSGTADGLDLGKVIARKGKIIRKLTAGIRSRLTEAGVEMVTAEATVTGCDADGIIGITAGEAQYKAANLLLCTGSETFIPPIPGVEQTEYWTNREALQNKEIPTSLVIIGGGVIGMEFASFFNGIGTQVHVVEMLPEILNGIDPEHAAMLRAHYEKEGIKFYLGHKVTSVRNGAVTVEYEGESKEIEGERILMSVGRRPVLQGFESLGLVLAGKGVKTNERMQTSLPNVYAAGDITGFSLLAHTAVREAEVAVDQILGKTDETMSYRAVPGVVYTNPEVAGVGETEESLRKAGRAYTVRRLPMAFSGRFVAENEQGNGECKLLLDEENRLIGAHLIGNPAGELIVTAAMAIETGMTDRQIERIIFPHPTVGEILKETLAGG

SEQ ID NO: 282 - protein, 945 aa, Porphyromonas gingivalis
PKILMELKRFLSLGLLLVGFIPMKLSAQQAQPLPTDPAVRVGKLDNGLTYFIRHNENPKDRADFFIAQKVGSILEEDSQSGLAHFLEHMAFNGTKNFPGKNLINYLETIGVRFGQNLNASTGFDKTEYTIMDVPTTRQGIIDSCLLILHDWSNNITLDGHEIDEERGVIQEEWRARRDANLRMFEAILAKAMPGNKYAERMPIGLMDVVLNFKHDELRNYYKKWYRPDLQGLVIVGDIDVDYVENKIKELFKDVPAPVNPAERIYTPVEDNDEPIVAIATDAEATTTQLSISFKSDPTPQEVRGSIFGLVEDYMKQVITTAVNERLSEITHKPNAPFLSAGAFFSNFMYITQTKDAFNFVATVREGEAEKAMNALVAEIESLRQFGITKGEYDRARTNVLKRYENQYNERDKRKNNAYANEYSTYFTDGGYIPGIEVEYQTVNAFAPQVPLEAFNQAIAQMIDPVKNAVVTLTGPSKAEAKIPSEADFLAAFKAARQQKVEAKKDEVSDQKLMEKAPKAGKIVSEKKDQKFGTTELTLSNGIKVYLKKTDFKSNEILMSALSPGGILSGKHAPNQSVMNSFMNVGGLGNFDAIQLDKVLTGRSASVSPSLSLLSEGLSGKTTVEDMETFFQLIYLQMTANRKDPEAFKATQEKLYNNLKNQEANPMAALMDSIRHTMYGDNPMMKPMKAADVEKVNYDQVMAFYNERFADAGDFMFFFIGNLDEAKMKPLIETYLASLPNLKRGDKMNKAQVPAARSGKIDCKFEKEMDTPSTTIFDVVSGNVEYTLKNSLLLEVFSAVMDQVYTATVREKEGGAYSVAAFGGLEQYPQPKALMQIYFPTDPARAEEMNAIVFAELEKLAKEGPNVEYFKKTIENLNKQHKESLRENRFWLEAMKASFFEGNDFITDYESVLNGLTPAELQKFAADLLKQQNRVVVMMAPVAKAQ

SEQ ID NO: 283 - protein, 686 aa, Porphyromonas gingivalis
YTMSKKGTIGVTSDNIFPVIKKFLYSDHEIFLREIVSNAVDATQKLKTLTSVGEFKGETGDLRVTVSVDEVARTITVSDRGVGMTEEEVEKYINQIAFSSAEEFLEKYKDDKAAIIGHFGLGFYSAFMVSERVDVITRSFREDATAVKWSCDGSPEYTLEPADKADRGTDIVMHIDEENSEFLKKEKIEGLLGKYCKFLTVPIIFGKKQEWKDGKMQDTDEDNQINDTHPAWTKKPADLKDEDYKEFYRSLYPMSEEPLFWIHLNVDYPFNLTGILYFPKIKNNLDLQRNKIQLYCNQVYVTDEVQGIVPDFLTLLHGVIDSPDIPLNVSRSYLQSDANVKKISSHITKKVADRLEEIFKNDRPTFEEKWDSLKLFVEYGMLTDEKFYERAAKFFLFTDMDGHKYTFDEYRTLVEGVQTDKDGQVVYLYATDKHGQYSHVKRASDKGYSVMLLDGQLDPHIVSLLEQKLEKTHFVRVDSDTINNLIRKEERAEVKLSDTERATLVKLFEARLPRDEKKHFNVAFESLGAEGEAILITQAEFMRRMRDMAQLQPGMSFYGELPDSYNLVLNTDHPLIDRVLSGEKESVEPSLTELRAKIAELKAEEAKLLDEEKGKKPEEIPVATKEAKENNAVEQAKTEGSINDQLTKYAQDNELIGQLIDLALLGSGLLTGEALAEFIRRSQRLL

SEQ ID NO: 284 - protein, 482 aa, Porphyromonas gingivalis
DIRQKRPCFNANLYFYRAMEKLIDILVVDDDVAVCAALRLVLKRAGYNPVIANSPDEALSIMRNPDGGCKPAVILMDMNFSLSTSGREGLELLEKMQIFTSCPVILMTAWASIPLAVEGMRLGAFDFIGKPWDNDRLLRTIDTALHLAAPSAVANPSEQSDRDTARQPKATVQENDPCAHIIGRSDAICKIKERIRRIAPTHASVLITGESGTGKELIAEALHRGSKRASAPFVKVNLGGIPESLFESELFGHKKGAFTNAFSDRKGRFELADGGTIFLDEIGELPVGNQVKLLRVLQEQTFEPLGESVSHRVDIRVVSATNASLERMVAEGRFREDLYYRINLIHLHLPPLRERQEDIQLLVEAFSEAFAQSNGLPHAVWSAEAMRRICAMPLPGNVRELKNVVERTLLLSGSREISARDVADFGSQVTAADHSDERALTDMEEAAIRETLTKYNGNVSRAARALGLSRAALYRRMEKYGL

SEQ ID NO: 285 - protein, 263 aa, Porphyromonas gingivalis
RSLQSFQNKKHSSMLKIKNLHATVQGKEILKGINLEINAGEIHAIMGPNGSGKSTLSSVLVGHPSFEVTEGEVTFNGIDLLELEPEERAHLGLFLSFQYPVEIPGVSMVNFMRAAVNEHRKAIGAEPVSASDFLKMMREKRAIVELDNKLASRSVNEGFSGGEKKRNEIFQMAMLEPKLAILDETDSGLDIDALRIVAGGVNRLRSPENAAIVITHYQRLLEYIKPDFVHVLYKGRIVKSGGAELALTLEEKGYDWIKEEIGE

SEQ ID NO: 286 - protein, 462 aa, Porphyromonas gingivalis
SMAKEKTIYVCRSCGTKYAKWQGNCNACGEWNCIDEEKVPAPASGKHAAKSFMPREQDNRPRLLQDVESGDEERIRLGDEEFDRVLGGGIVKGAFVLLGGEPGIGKSTLILQTVLRLPQLRTLYVSGEESARQLKMRAERLGQAMNGCYVYCETNIERILSRAEELTPDLLVIDSIQTVYTEEMESSAGSVGQIRECAALLLKYCKTTGIPVIVIGHITKEGSIAGPKVLEHIVDTVLLFDGDKHHLYRILRGQKNRYGSTSELGIYEMRQDGLRGVENPSEHLITRNREDLSGIAIAVAMEGIRPILIEAQALVSSAIYANPQRSATGFDIRRMNMLLAVLEKRAGFKLIQKDVFLNIAGGIKIADPATDLAVISAVLASSLDIVIPPAVCMTGEVGLSGEIRPVSRIEQRITEARRIGFKEILVPADNFRQEDAGRFGIRLVPVRKVEEAFRHLFSKGRE

SEQ ID NO: 287 - protein, 373 aa, Porphyromonas gingivalis
GSCGSSPAIGRSGCSRCDRRIGHGLSTSAFRTYAGLVCHSRLRDQSSCRVCGMRPIGQLFFPSCPRRSASDAGRTERIQSPLQNLLQEMQFSPTNRRNPFDNMNSRHLTITIIAGLSLFVLTLGGCSVAQQDTQWTLGGKLFTSAWIQRSAEYQALCIQAYNIATERVDALPAERKQGDRPYAIVTDIDETILDNTPNSVYQALRGKDYDEETWGKWCAQADADTLAGALSFFLHAANKGIEVFYVTNRRDNLREATLQNLQRYGFPFADEEHLLTTHGPSDKEPRRLKIQEQYEIVLLIGDNLGDFHHFFNTKEESGRKQALGLTAGEFGRHFIMLPNPNYGSWEPAWYGGKYPPLPERDKALKQLHSQNSR

SEQ ID NO: 288 - protein, 426 aa, Porphyromonas gingivalis
RWGFSNFVAMSTNIDVQQIKQRFGIIGSSPLMEHAIRVAAQVAPTDMSVLVTGESGSGKEFFPQIIHYYSARKHHSYIAVNCGAIPEGTIDSELFGHRKGSFTGAVSDRKGYFEEASGGTIFLDEVGELPLPTQARLLRVLETGEFIPVGASQSQKTDVRIVAATNVNLKEAVANGKFREDLFFRLNTVPIEVPALRMRPDDVPLLFRRFAADSAEKYRMPPLRLSDEARTILMRYRWPGNVRELRNITDRLSILEEERTVSAETITRYLDAEGMQDLHPVVIRRNETTEADKQIPHYEREIIYQVLYDMKKEIADLKGMMNRLAHHEQPSWPVGSDVWGNDDKRTADPKWGVSTHKAPIANAAEPVEPIQEASEYTEDPVSLEEVEKKMISLALERHGGRRKQTAEELKISERTLYRKIKEYGLE

SEQ ID NO: 289 - protein, 653 aa, Porphyromonas gingivalis
KNLPRYAPAFGRNRKREQPDPDNDDSRGRSHRQSGRAVTVVCRRIQTPLPHMILLFGGTTEGRAAARVLDEAGSPFFYSTKGNLQEIQSSHGHRLTGAMTVADMVSFCRKEEIRLIVDAAHPFAEELHASVAEASEQTGIPVVRYERQYPPREEGIVWCANYDTAAERMLGDGVQRLLMLTGVNTIPKLAAFWKERTTFCRILKRDESVALAEKNGFPAERIVFFEPHADEELMQAVRPDAIITKESGESGYFREKIEAARRMGIRIYAVVRPPLPPSFIPVGGPVGLRRAVERLVPGFFSLRSGFTTGTTATAAVVAAMYRLMGLGSLAEAPVELPSGEIVSLPIAEIREEEDAVVSAVLKDAGDDPDVTNGMAVCATIRLNPEHEEVRFLQGEGVGVVTLPGLGLEVGGPAINLVPRRMMTAEVRRLYAQGGVDITISVPEGREAATQTFNPRLGIRDGISIIGTSGVVKPFSAEAFVGAIRKQVGIATALGANHIVLNSGAKSERYVKGAYPALIPQAFVQYGNFVGESLSCVASFPSVRSVTVGIMLGKAVKLAEGYLDTHSKKVVMNRDFLHELARQAGCSEDIHAIIDSLNLARELWTMPSAEDSDRLLRKIAERSWETCRPSVPSAELELLLIDESGAIRFRIGGE

SEQ ID NO: 290 - protein, 451 aa, Porphyromonas gingivalis
QQRPHRIIMLRTFRIGGIHPPENKLSAGKPVEVLPIPSQVVIPLGQHIGAPATATVKKGDEVKVGTIIAQAGGFVSANIHSSVSGKVLKIDNVYDSSGYPKPAVFISVEGDEWEEGIDRSPAIVKECNLDAKEIVAKISAAGIVGLGGATFPTHVKLSPPPGNKAEILIINAVECEPYLTSDHVLMLEHGEEIMIGVSILMKAIQVNKAVIGVENNKKDAIAHLTKLATAYPGIEVMPLKVQYPQGGEKQLIDAVIRKQVKSGALPISTGAVVQNVGTVFAVYEAVQKNKPLVERIVTVTGKKLSRPSNLLVRIGTPIAALIEAAGGLPENTGKIIGGGPMMGRALLSPDVPVTKGSSGVLILDREEAVRKPMRDCIRCAKCVGVCPMGLNPAFLMRDTLYKSWETAEKGNVVDCIECGSCSFTCPANRPLLDYIRQAKKTVMGIQRARKQ

SEQ ID NO: 291 - protein, 489 aa, Porphyromonas gingivalis
MNSQKKEAFNMKRIQLTLIALFAAVAGLVAQNAYEGVISYKISLDKTGNKVVLNGAADMSNLKLKSTQMIIVTPILRSEDGTSRVEFPSVVITGRNRTKALKREIAFSSALPQAKHAAQYIRRHNGKSEQFAFTGEHAYASWMMDAKFVVREEVRGCAKCPVGLSSNIVPFDPLFNPAEAPYLLAHITPAEEVEKQRESSFDAYINFKVNKADVLPEYRNNKAELEKIKEFVSTVKANPNYSVNKMIIEGFASPEASIAHNKALSERRAKRLAEELVRKYGKTLPNITTEFGGEDWKGLKLAIEKSDIADRDRVLEIINSDKYADDDAREQALKQLSSYRYILDQIYPNLRRNTITMGYIVRDYTLEEAREIIKTAPKELSEAEMYRVAMSYPEGHQERLFALNTTLKYFPESVTGRINLAVAAFNGGDVQQAIALLSPIQTEKGVSNILGAAYARTGDFARAETFFRKAVAEGDANAQRNLDMLLGKK

SEQ ID NO: 292 - protein, 384 aa, Porphyromonas gingivalis
DMAEKRDYYEVLGVSKNATDDELKKAYRKKAIQYHPDKNPGDKEAEEHFKEVAEAYDVLSDPQKRSQYDQFGHAGLGGAAGGGFSGGGMSMEDIFSRFGDLFGGFGGFGGFSDMGGGSRRRVRRGSDLRVRVKLSLADISKGVEKKVKVKKQVVCSKCRGDGTEEANGKTTCQTCHGTGVVTRVSNTFLGAMQTQSTCPTCHGEGEIITKPCSKCKGEGVEIGEEVISFHIPAGVAEGMQMSVNGKGNAAPRGGVNGDLIVVIAEEPDPNLIRNGNDLIYNLLISVPLAIKGGSVEVPTIDGRAKIRIEAGTQPGKMLRLRNKGLPSVNGYGMGDQLVNVNVYIPESIDAKDEQAIAAMENSDSFKPTDAARKDIDKKYREMLD

SEQ ID NO: 293 - protein, 309 aa, Porphyromonas gingivalis
RFDSTTNVSQINLRTEMKKLILATLGLMAIAMLSCSSNNKDLENKGEATLLVTFGSSYKAPRETYAKIEKTFAAAYPDQRISWTYTSSIIRKKLAQQGIYIDAPDEALEKLARLGYKKINVQSLHVIPGREYDEMIDFVNKFKAAHSDITVKVGAPLFDTDEDMREVAEILHKRFQQTIEKGEAIVFMGHGTEHAANDRYARINKIMKNYSKFMIVGTVESDPSINDVIAELKETGATAVTMMPLMSVAGDHATNDMAGDEDDSWKTLLTNAGYTVSIDKLDNGNFSALGDIEEIRNIWLKHMKATSAR

SEQ ID NO: 294 - protein, 491 aa, Porphyromonas gingivalis
RRDARRQLVRRRRKELSGTANTRCRRRVFPERRSAIRWCFPRLRDGLQPIRFGSLLANPQQLSRGVRLRSFESRRQPICRFQGIQGKRRDILQPEGNSLLRTHAHASRLGAGRSYRYLAPRTTSRPPTAFLLFAPMTSVSHLRTISVAGILAALGGAVLILFGVNLFLGSVAIPMSEIFRHLFSDRPEGGEALVHYNILWKSRLPEALTAAFAGAGLSVSGLQMQTVFRNPLAGPSVLGISSGASLGVALVVLLSGSLGGVALSSLGYMGEVAMNIAAAVGSLAVMGLIVFVSTKVRSHVTLLIIGVMIGYVATAVIGVFKFFSIEEDIRAYVIWGLGSFSRATDSQLSFFAILMLIFIPAGMLLVKQLNLLLLGESYARNLGLNTRRARLLVISSAGLLIATVTAYCGPIGFLGMAVPHLARVIFHTSDHRILMPATCLIGSALALFCNIIARMPGFEGALPVNSVTALVGAPIIVTVLFRRRRFKEETD

SEQ ID NO: 295 - protein, 763 aa, Porphyromonas gingivalis
HFLVTIMRTKTIFFAIISFIALLSSSLSAQSKAVLTGSVSDAETGEPLAGARIEVKHTNIVAGADAGGHFEIKNLPAGQHTIICSLGGYGQKEEVVAIEAGQTKTISFALRLRTNNLEEVVVTGTGTRYRLVDAPVATEVLTAKDIASFSAPTSEALLQGLSPSFDFGPNLMGSFMQLNGLSSKYILILIDGKRVYGDVGGQADLSRISPDQIERIELVKGASSSLYGSDAIAGVINVITKKNTNRLSAYTSHRISKYNDRQTNTSLDINIGKFSSNTNYFFYHTDGWQNSPFEIKKKKGSGEPVLEETYKKTFRAQENQGVSQSLSYYATNNLSFSGNVQYNKRQIFTPTFSEKKAYDMDYRALTASLGTNYLFPNGLHTLSFDAVYDRFRFGYLYHDKDSSESLINNQGQTEQPTFFPGQLRNKNDQIRYTAEARGVFTLPYAQKLTGGLEYFREELISPYNLITDKADASTLSAYVQDEWKPLDWFNMTAGFRLVHHQEFGTRMTPKVSILAKYGPLNFRATYANGYKTPTLKELFARNELTTMGSHNLYLGNADLKPQMSDYYALGLEYNQGPISFSATVYDNELRNLISFMDIPTSPEHEAQGIKKTKQYANIGKARSRGLDVLCDASIGWGIKLGAGYSLVEAKNLQTDEWLEGAARHRANVHADWVHYWGQYRLGVSLFGRIQSERYYKDGNAPDYTLWRLATSHRFAHFRHIILDGTLGIDNLFDYVDDRPMGVNYATVTPGRTFFAQIAIRFNN

SEQ ID NO: 296 - protein, 365 aa, Porphyromonas gingivalis
CCARLRDTSPRKKSFRNDTVFPYFVIHLIKHIIIMTDNKQRNIVFPAFLLLLGVIAVVTIVGFFMLRPAEEIIQGQIEVTEYRVSSKVPGRIKELRVSEGQQVQAGDTLAVIEAPDVAAKMEQAKAAEAAAQAQNAKALKGARSEQIQAAYEMWQKAQAGVAIATKTHQRVQNLYDQGVVPAQKLDEATAQRDAAIATQKAAEAQYNMARNGAEREDKLAASALVDRARGAVAEVESYINETYLIAPRAGEVSEIFPKAGELVGTGAPIMNIAEMGDMWASFAVREDFLSSMTMGAVLETVVPALNEEKVRFKITFIKNMGTYAAWKATKTTGQYDLKTFEVKATLADKDKAQKLRPGMSVIIRK

SEQ ID NO: 297 - protein, 320 aa, Porphyromonas gingivalis
PQSSPDRRSFQNVMNKYHSQSVLEVGKIGIVIIFAPIVRNVHQQPPFLSHKSIMRIVSNFLFVSFSVLLFASCRSQREKVVYLQDIQTFNREIIAKPYDVKIEKDDVLNILVSSRDPELSTPYNQVLTTRALARNGYGTNSNEGFLVDSKGYINYPILGQIYVEGLTRTELEKEIQKRIISSGFIKDPTVTVQLQNFKVSVLGEVNHPGSMSVKGERITLLEAIGMAGDLTIYGRRDRVFVIRETDGHREVFQTDLRKADLLASPVYYLHQNDVIYVEPNDKKTQMSEINQNNNVNVWLSVTSTLVSISTLTITIIDKTK

SEQ ID NO: 298 - protein, 582 aa, Porphyromonas gingivalis
SKIVLRKFCTLARMKKTNLFLSLLVIFITGSFMTACAQKSKTNKLTEEDRSRNEYVQSMDVLSNIIGNVRLYFVDTISIKHMTRRGIDAMLGGLDPYTEYIPYEEMDELKLMTTGEYAGVGAIISQRPDSAVIIQRPMEGMPADEAGLIAGDRILTIDGKDFRKSTTPKVSQALKGIAGTVAKVTVMRYGETKPRTFSVKRQKVIMNSVTYSGMLDGSIGYIRLNNFTDKSAEEVRTALLDLRDKQGAKGLILDLRGNGGGLMQAAIEIVNLFVPKGKEVVTTKGRIAESASVFRTLTEPIDTKLPIVVLIDGQSASSSEIVAGALQDMDRAVLMGQKSYGKGLVQTTRQLPYNGVIKLTTAKYYIPSGRCIQRLDYSRTNRTGMATAIPDSLHKIFYTAAGRRVEDAGGILPDIEVKQDTAATLLYYMAINNDVFDFVTGYVLKHKTIAKPEDFSITNEDYAAFCKMMEEKKFDYDRQSGKMLDKLEELAKIEGYLPEANSELKALREKLKPNLSRDLLRFKKEITNYLNNEIVTRYYYERGSIRQSLPEDKVVKEAIKLLKDHPEQIRQILAAPKAENKG

SEQ ID NO: 299 - protein, 985 aa, Porphyromonas gingivalis
VTDKMQNKGFVIVITSALAIICAFYLSFSFVTNRYEKKAKAMGDVAGMAYLDSMSNEKVWFGYTLKEAQAQQIGLGLDLKGGMNVILKLNASDLLRNLSNKSLDPNFNKALENAAKSTEQSDFIDIFVKEYRKLDPNGRLAVIFGSGDLRDQITAKSTDADVVRLLKEKYNSAVEASFNVLRARIDAFGVVAPNLQRLEGQGRILVELPGVKDPERVRTLLQRSANLQFWRTYKFEEVSGDLIAANDRLSELAMNNTDATPETEPATTDSVAATADSAAVQAVADSATVAQKEAKDATRKDALFSLLTPVNRGGAVVGVARRANMAQISEMLQQAHDLKVTREDVLFLWGAKAIEDPETKKETDLYELYAIRTNRTGDPDLGGDVVTSAKSDIQNDFGRSEPIVSMTMNEEGARKWARITKDNVGRAIAIVLDGVVYSAPNVNDEITGGRSQISGHFTVEEAGDLANVLNSGKMDATVSIEQENVIGPTLGAESIKAGFLSFLLALVILMCYMCLAYGFLPGLIANGALIVNSFFTLGVLASFHAVLTLSGIAGLVLTLGMAVDANVLIFERIKEELRAGKTPIRAVTDGYGNAFSAIFDSNVTTIITGIILFLYGTGPIRGFATTLIIGLIASFITAVFLTRIVFEKLAKKGRLDKITFTTSITRNLLVNPSYNILGKRKTGFIIPVIIIVLGLIASFTIGLNRGIEFSGGRNYVVKFDQPVSSEAVRSALSSPLQEKVLVTSIGTEGTEVRISTNYKIQEESEETEAEITDKLYQSLKGFYTQQPTADQFLDNIISSQKVSPSMSSDITRGAIWAVLLSMIFMAIYILIRFRDISFSAGVFVSVAATTFCIIALYALLWKILPFTMEIDQNFIAAILAIIGYSLNDTVVVFDRIRETMKLYPNRDRYQVINDALNSTLGRTLNTSLTTFIVMLVIFIFGGATMRSFTFSILLGIVIGTYSTLFVATPLAYEIQKRKLNKAAKK

SEQ ID NO: 300 - protein, 1046 aa, Porphyromonas gingivalis
DFPWVRVKPEKKRKQHNSNNFKFNAKEKSMKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVMTTSGDPTAVASVEIHGTGSLGASSAPLYIVDGMQTSLDVVATMNPNDFESMSVLKDASATSIYGARAANGVVFIQTKKGKMSERGRITFNASYGISQILNTKPLDNMMTGDELLDFQVKAGFWGNNQTVQKVKDMILAGAEDLYGNYDSLKDEYGKTLFPVDFNHDADWLKALFKTAPTSQGDISFSGGSQGTSYYASIGYFDQEGMAREPANFKRYSGRLNFESRINEWLKVGANLSGAIANRRSADYFGKYYMGSGTFGVLTMPRYYNPFDVNGDLADVYYMYGATRPSMTEPYFAKMRPFSSESHQANVNGFAQITPIKGLTLKAQAGVDITNTRTSSKRMPNNPYDSTPLGERRERAYRDVSKSFTNTAEYKFSIDEKHDLTALMGHEYIEYEGDVIGASSKGFESDKLMLLSQGKTGNSLSLPEHRVAEYAYLSFFSRFNYGFDKWMYIDFSVRNDQSSRFGSNNRSAWFYSVGGMFDIYNKFIQESNWLSDLRLKMSYGTTGNSEIGNYNHQALVTVNNYTEDAMGLSISTAGNPDLSWEKQSQFNFGLAAGAFNNRLSAEVDFYVRTTNDMLIDVPMPYISGFFSQYQNVGSMKNTGVDLSLKGTIYQNKDWNVYASANFNYNRQEITKLFFGLNKYMLPNTGTIWEIGYPNSFYMAEYAGIDKKTGKQLWYVPGQVDADGNKVTTSQYSADLETRIDKSVTPPITGGFSLGASWKGLSLDADFAYIVGKWMINNDRYFTENAGGLMQLNKDKMLLNAWTEDNKETDVPKLGQSPQFDTHLLENASFLRLKNLKLTYVLPNSLFAGQNVIGGARVYLMARNLLTVTKYKGFDPEAGGNVGKNQYPNSKQYVAGIQLSF

SEQ ID NO: 301 - protein, 869 aa, Porphyromonas gingivalis
WHRNIFIFASTFSPKNMLPLPYRYAKTEHLFLAKGYCKNPITNIIILFMKKKNFLLLGIFVALLTFIGSMQAQQAKDYFNFDERGEAYFSFKVPDRAVLQELALIMSIDEFDPVTNEAIAYASEEEFEAFLRYGLKPTFLTPPSMQRAVEMFDYRSGEKYEWNAYPTYEAYISMMEEFQTKYPSLCTTSVIGKSVKDRKLMICKLTSSANTGKKPRVLYTSTMHGDETTGYVVLLRLIDHLLSNYESDPRIKNILDKTEVWICPLTNPDGAYRAGNHTVQGATRYNANNVDLNRNFKDDVAGDHPDGKPWQPEATAFMDLEGNTSFVLGANIHGGTEVVNYPWDNKKERHADDEWYKLISRNYAAACQSISASYMTSETNSGIINGSDWYVIRGSRQDNANYFHRLREITLEISNTKLVPASQLPKYWNLNKESLLALIEESLYGIHGTVTSAANGQPLKCQILIENHDKRNSDVYSDATTGYYVRPIKAGTYTVKYKAEGYPEATRTITIKDKETVIMDIALGNSVPLPVPDFTASPMTISVGESVQFQDQTTNNPTNWEWTFEGGQPAMSTEQNPLVSYSHPGQYDVTLKVWNASGSNTITKEKFITVNAVMPVAEFVGTPTEIEEGQTVSFQNQSTNATNYVWIFDGGTPATSEDENPTVLYSKAGQYDVTLKAISASGETVKTKEKYITVKKAPVPAPVADFEGTPRKVKKGETVTFKDLSTNNPTSWLWVFEGGSPATSTEQNPVVTYNETGKYDVQLTATNEGGSNVKKAEDYIEVILDDSVEDIVAQTGIVIRPQNGTKQILIEANAAIKAIVLYDINGRVVLKTTPNQLRSTVDLSILPEGIYTINIKTEKSARTEKIHIG

SEQ ID NO: 302 - protein, 106 aa, Porphyromonas gingivalis
LSYSGESDAKESDQNCRKCTFIGFEKRVNTMRLIKAFLVQLLLLPIFFYKRFISPLTPPSCRFTPSCSSYAIEALRKYGPGKGLLLSIKRILRCHPWGGSGYDPVP

SEQ ID NO: 303 - protein, 861 aa, Porphyromonas gingivalis
LEMAYDFTQTFRNSLEYSYQEATRLGVVAVTQDMLVLGIIRDGDNGAIDIMRHYGINLYELKRLIELEAIAESLPASPEGSPIFTPSAREAIDDATDICADMEDEAVSPVHLLLSILNSTQESLVQKIFMKQGIKYDTILSDYFGQRNPSEGKSPSEMEILDGYQDNDFDDEEDESSPPSGNSGTGGGSGDAPEQNTGGGDTTTTTRSGGDTPALDTFGTDITAMAAAGKLDPVVGREQEIERVIQILSRRKKNNPVLIGEPGVGKSAIVEGLAERIVNRKVSRILFDKRIISLDLAQMVAGTKYRGQFEERLKAVLDELKKNPQIILFIDEIHTIVGAGSAAGSMDTANMLKPALARGQVQCIGATTLDEYRKNIEKDGALERRFQKVPIAPSTAEETLTILQNIKEKYEDYHGVRYTDEAIKAAVELTDRYVSDRFFPDKAIDAMDEAGASVHITNVVAPKEIEILEAELASVRENKLSAVKAQNYELAASFRDQERRTQQQIAEEKKKWEEQMSKHRETVDENVVAHVVALMTGVPAERLSTGEGERLRTMADDLKTKVVGQDTAIEKMVHAIQRNRLGLRNEKKPIGSFLFLGPTGVGKTYLAKKLAEYLFEDENAMIRVDMSEYMEKFSVSRLVGAPPGYVGYEEGGQLTERVRRKPYSVVLLDEIEKAHADVFNLLLQVMDEGQLTDSLGRRVNFKNTVIIITSNVGTRQLKDFGQGIGFRSEKDEEANKEHSRSVIQKALNKTFSPEFLNRLDDIILFDQLGKTEIRRMVDIELKAVLARIHRAGYDLVLTDEAKDVIATKGYDLQYGARPLKRTLQNEVEDRLTDLILSGQIEKGQTLTLSARDGEIIVQEQA

SEQ ID NO: 304 - protein, 456 aa, Porphyromonas gingivalis
RGGQIRRHHTDSSRGSDSKACRFSFHAETIGFSNHQRAKMNYLYILITLLLSGFFSGAEIAFLSSDKLRLELDRNRGDLTGRALNLLYRHPDQLVTTLLVGNNIVLVVYGLLMAGLLAAPLAQWIDNDAMIVVLQSVLSTIIILFTGEFLPKAIFKTNANMMMRVFALPIVAIYYLLYPLSKLFTGLSRSFIRLVDKNYVPTTVGLGRVDLDHYLAENMSGENEQNDLTTEVKIIQNALDFSGIQVRDCMIPRNEMIACELQTDIEVLKTTFIDTGLSKIIIYRQNIDDVVGYIHSSEMFRGQDWQKRINTTVFVPESMYANKLMRLLMQRKKSIAIVIDELGGTAGMVTLEDLVEEIFGDIEDEHDTRKIIAKQLGPHTYLVSGRMEIDDVNERFGLSLPESDDYLTVAGFILNSHQNIPQANEVVEIAPYTFTILRSSSTKIELVKMSIDDQSN

SEQ ID NO: 305 - protein, 299 aa, Porphyromonas gingivalis
LKKEITMKQNYFKRVCSLLWLVLPMLIMPLEVAAQEIIPNEEVLESLTFVAPVEETDAIEAEVEALQEIVATEEIAEQAVRSYTYTVYRDGVKIASGLTEPTFLDEDVPAGEHTYCVEVQYQGGVSDKVCVDVEVKDFKPVTNLTGTASNDEVSLDWDGVEEKAEEPASDKAVSYNVYKNGTLIGNTAETHYVETGVANGTYIYEVEVKYPDGVSPKVAVTVTVTNSSLSNVDGQAPYTLRVEGKKIIAEAHGMITLYDINGRTVAVAPNRLEYMAQTGFYAVRFDVGNKHHVSKIQVR

SEQ ID NO: 306 - protein, 377 aa, Porphyromonas gingivalis
LFNHKKSWYETFQFYLVVFRSGFILLCENTLAQQKTEEFAPVSDLRAEAYGSTVFLHWTPPYDNPMIPLSESFESGIPAIWKTIDADGDGYNWMHLTNFTGQSGLCVSSASYIGGVGALTPDNYLITPELKLPTDALVEIIYWVCTQDLTAPSEHYAVYSSSTGNNAADFVNLLYEETLTAKRIQSPELIRGNRTQGVWYQRKVVLPNDTKYVAFRHFNSTDNFWLNLDEVSILYTPLPRRAPCPHPGGYTYSVFRDGQKIASGLSALAYIDTDVPYGTQDYCVQVNYLQGDSYKVCKNIVVANSANIYGADKPFALTVVGKTIVASAFKGEITLYDIRGRLIASGCDTLRYKAENGFYLIKIQVNGTVYTEKIQIQ

SEQ ID NO: 307 - protein, 849 aa, Porphyromonas gingivalis
FGISPSMKKSFLLAIVMLFGIAMQGHSAPVTKERALSLARLALRQVSLRMGQTAVSDKISIDYVYRQGDAERGITSQEEGSPAYFYVANRGNNEGYALVAADDRIPTILAYSPIGRFDMDSMPDNLRMWLQIYDQEIGLILSGKAQLNEEILRTEGVPAEVHALMDNGHFANDPMRWNQGYPWNNKEPLLPNGNHAYTGCVATAAAQIMRYHSWPLQGEGSFDYHAGSLVGNWSGTFGEMYDWINMPGNPDLDNLTQSQVDAYATLMRDVSASVSMSFYENGSGTYSVYVVGALRNNFRYKRSLQLHVRALYTSQEWHDMIRGELASGRPVYYAGNNQSIGHAFVCDGYASDGTFHFNWGWGGVSNGFYKLTLLSPTSLGIGGEGIGFTIYQEIITGIEPAKTPAEAGTDALPILALKDIEAEYKSESGLNVGYSIYNTGEEQSNLDLGYRLNKADGEVIEVKTSSINISWYGYGEHPESFSLAPNQLSQGINTITLLYRRTGTEQWEPVRHAQGGYVNSIKVNTTDPNNVVVTVDNNEGKLSIVPNSFVADLNSYEHSTITVQFNSDSPDEIRTPVAFALSTGATADDVISLGWVMAEVPGGSSNYPVVWSKDVLTLSEGDYTLWYRFSINNQKDEWKKIGSVSVKTPTEYTHPLFEVGHNQTSTYTLDMAHNRVLPDFTLKNLGLPFNGELVVVFRQTQSSSGSLWAAQETVHIKQGETFVYKPVVEGPIPDGSYRATLHAFVNGQQQLYLKGKRNYTVKIVNGTAVEAIESSEEIRVFPNPARDYVEISAPCIPQETSIILFDLSGKIVMKNSLSAGHGRMDVSRLPNGAYILKVDGYTTKINIVH

SEQ ID NO: 308 - protein, 295 aa, Porphyromonas gingivalis
TKKTLMKKLFLSLTSLVMVFAVASCDIIDKDQTLLPAPTNVTPDNPDDNPSEIDITQTHTEKYVLAEEFTGQKCLNCPKGHRKLAALKEQYGKRLTVVGIHAGPGSLVPPLFRTEAGDAYYSKFANNTPLPALMVSRKKFGSSYVYDKSYKTWDVPIAEQMEQKAKINIFAVAEYTDTQKIKVTVKGKILEGNTLPKSMVQVYLLEDKLIAPQVDGNTTVENYEHNHVLRGAVNGIWGEEFVNLKDYLYTYAVEPLSGMSFVAENYSIVAFVYDVQTFEVYDVVHVKINPQSDGK

SEQ ID NO: 309 - protein, 230 aa, Porphyromonas gingivalis
TNKKEETMKKSSVVASVLAVALVFAGCGLNNMAKGGLIGAGVGGAIGAGVGNVAGNTAVGAIVGTAVGGAAGALIGKKMDKQKKELEAAVPDATIQTVNDGEAILVTFDSGILFATNSSTLSPNSRTALTKFAANMNKNPDTDIRIVGHTDNTGSDKINDPLSERRAASVYSFLNSQGVSMSRMAAEGRGSHEPVADNSTVAGRSANRRVEVYILPNAKMIEQAQQGTLK

SEQ ID NO: 310 - protein, 342 aa, Porphyromonas gingivalis
NRNRNMSKKSILLLCCSLCFISATKAVTPVRNVRNSQVNSKAKTERTKPSDSVRYISNMIADRLEFRNKISSEKEVRKAEYENRLAMEALNYPAIDLYGEDSWSEYVNPFVGAGTDVEIPNSYDIDCSSFVMPVEDKQVTSQFGYRRRFGRMHYGIDLSVNRGDTIRAAFDGKVRVRSYEARGYGYYIVLRHPNGLETVYGHMSRQLVDENQIVRAGQPIGLGGSTGRSTGPHLHFETRFMGIPINPSTIIDFDNGVPLRDIYTFKRGSNSRYAKASKTSSRYAKKGKKGRQASSPMTYRIKKGDTLETIAKRHGTSVQKLCATNGIGKSKILTPGKALRIK

SEQ ID NO: 311 - protein, 159 aa, Porphyromonas gingivalis
PSKTIIKTMAKINFYAEGVSLPRIRRRIVGKWIAEVCSRYGKAVGEISYLFCDDEYILKANQEFLDHDYYTDIITFDSCEADTVNGDLLISLDTVRSNARALDLRYEDELHRVIIHGILHLCGLKDKSKKDEAQMRAAEEKALVMLRETIGSELSLLHT

SEQ ID NO: 312 - protein, 395 aa, Porphyromonas gingivalis
  MOD_RES (245)..(245): Xaa can be any naturally occurring amino acid
KSKTMKVKYLMLTLVGAIALNASAQENTVPATGQLPAKNVAFARNKAGSNWFVTLQGGVAAQFLNDNNNKDLMDRLGAIGSLSVGKYHSPFFATRLQINGGQAHTFLGKNGEQEINTNFGAAHFDFMFDVVNYFAPYRENRFFHLIPWVGVGYQHKFIGSEWSKDNVESLTANVGVMMAFRLGKRVDFVIEAQAAHSNLNLSRAYNAKKTPVFEDPAGRYYNGFQGMATAGLNFRLGAVGFNAIXPMDYALINDLNGQINRLRSEVEELSKRPVSCPECPEVTPVTKTENILTEKAVLFRFDSHVVDKDQLINLYDVAQFVKETNEPITVVGYADPTGNTQYNEKLSERRAKAVVDVLTGKYGVPSELISVEWKGDSTQPFSKKAWNRVVIVRSK

SEQ ID NO: 313 - protein, 387 aa, Porphyromonas gingivalis
YKMTYRIMKAKSLLLALAGLACTFSATAQEATTQNKAGMHTAFQRDKASDHWFIDIAGGAGMALSGWNNDVDFVDRLSIVPTFGIGKWHEPYFGTRLQFTGFDIYGFPQGSKERNHNYFGNAHLDFMFDLTNYFGVYRPNRVFHIIPWAGIGFGYKFHSENANGEKVGSKDDMTGTVNVGLMLKFRLSRVVDFNIEGQAFAGKMNFIGTKRGKADFPVMATAGLTFNLGKTEWTEIVPMDYALVNDLNNQINSLRGQVEELSRRPVSCPECPEPTQPTVTRVVVDNVVYFRINSAKIDRNQEINVYNTAEYAKTNNAPIKVVGYADEKTGTAAYNMKLSERRAKAVAKMLEKYGVSADRITIEWKGSSEQIYEENAWNRIVVMTAAE

SEQ ID NO: 314 - protein, 195 aa, Porphyromonas gingivalis
VIGIIMEFFMLFIAAVFVNNVVLSQFLGICPFLGVSKKVDTSIGMGAAVTFVLALATLVTFLIQKFVLDRFGLGFMQTIAFILVIAALVQMVEIILKKVSPPLYQALGVFLPLITTNCCVLGVAILVIQKDYTLLQSFVYAISTAIGFTLAMVTFAGIREQLDMTNLPKAMKGIPSALLAAGILAMAFMGFSGIA

SEQ ID NO: 315 - protein, 876 aa, Porphyromonas gingivalis
YRSYRGIGSGTHSPNLKNRLKRIGIRIPNRHYIHIKPIKPKNKMKQLNIISFIIAFLFLGTSASAQQSGGSVTGTVVDKSSKEPIAYVQVFVKGTTLGTSTDANGNYSIKGIPSGNQTIVARLMGYSTCEEKVHIEKGGSRHVDLYLTEEILSLDGVVVSANRNETFRRQAPSLVTVLSPELFLKTNSTNLSQGLKFQPGLRVEDNCQNCGFNQVRINGLEGAYSQILIDSHPIFSSLAGVYGLEQMPANMIERVEVIRGGGSALFGSNAVGGVINVITKEPLRNSAEISHSTMTFDHAKGWGSFQNTTQFNGSMLTEDRKAGVMVFGQHNYRPGQDIDGDNFTELPNLRNRSLGFRSYYKTGLYSKATLEYHSMQEYRRGGDRLDNPPFEAQIAEYLQHYINGGSFKFDQGFSGGKDFFSLYASAQDVQRRSYYGGGDYTENLLNGAVQSGSTESDEYNDAFTALTSYGTTKGFDLQGGGMYRHTFGENWDFTGGLEYIYGQLDDRSGYRPSKIDQNTSTFSQYDQLEYKTEKLSALIGARIDYVLLNQDGKRYIDPLFIFSPRANVRYNPNKNLSFRLSYSEGFRAPQYFDEDLHVELAGGTPISRVLSPNLKEERSRSISASFDYYHRADEWQFNIMGEAFSTFISNQFKPSDKVETTSDGKEWIIRTIYNDKDGVSKVYGVNLEGRIAYNKSFDLQLGGTWQRSRYGSIYTAVEADKTTGQAEISVKDYVRTPNLYGYFVATVRPTEHFAINLSGTFTGKMDVVHEAYEGDIPAEHIAPDGSFDFEMNGQQFKGLAEGHAKLVKTPAFADIDLKLSHDFHLASTMTLELNAGIQNIFNSYQKDTDKGPGRASTYVYGPMQPRRIFVGTKINF

SEQ ID NO: 316 - protein, 899 aa, Porphyromonas gingivalis
ILNHLRKTMYKKIIAVAALFCASIGILKGQSSDLTPQDTIYSPEISYAKPIHKTIASIEIEGMRSFDDFVLRNLSGLAVGDEVLIPGDAMSAAVNRIMRQGYFSNVRIIADKYVGNKVYLKIIVTERPRISKVTFSGVKKSEREDLEMKIGLREGIQMTRNNEDKVRQIVQKYFSEKGYRDASIRITQEPDLSKDGFVNVLISIEKKSKTKVNEIYFSGNKALSNHKLRMAMKNTNAKFSLRKHIRSSFLKLFSTHKFVEESYREDLVRLIEKYQEYGYRDAEILTDSVVKAPDGKRVDIYLNIEEGQKYYIKDVNFVGNSQYPSEYLERVLGIKSGDVYNQRRLAKRLNEDEDAVGNLYYNNGYIFAWVDPVETNVVGDSVSLDIRIAEGKQANINKVIIKGNTVVYEDVVRRELYTKPGQLFSREDIINSIRLINQLGHFDAEKSIPRPIPNPETGTVDIEYDLVPRSSDQLELSVGWSQSGLLFRGAIKFTNFSVGNLLHPSMYKKGIIPQGDGQTLSLSAQTNGKYYQQYSVTFMDPWFGGKRPDMFSFSAFYSKTTAIDSKFYNSNAGNYYNAYYNSYYNNYNSYYNGMSNYTGDLYTQASDPDRSLQMLGTSIGYGKRLTWPDNWFQIYTSLNYTYYRLRNWSYNTFQNFHHGSANDLNLELRLSRTSIDNPIYTRSGSDFMVSVAATLPYSLWDNHDYASQNLSVSDRYRFIEYHKWKFRGRVFTPLLNPATHKYTPVLMSRVEGAVLGSYNSNKKSPFGTFYMGGDGMSSYYGGYMNETIGLRGYKNGSIAGNNYDYAYAYMRLTMELRFPILFENSFNAWLLAFAEAGNAWRSIDNYNPFNLKRSAGVGLRVTLPMVGMLGIDWGYGFDRPDNSLQRGGSNVHFVLGQEF

SEQ ID NO: 317 - protein, 177 aa, Porphyromonas gingivalis
QINMNGDMKRFLILIGFALAVAFSGFSQKFALVDMEYILRNIPDYEMMNEQLEQVSKKWQNEIEALENEAQSMYKKYQSDLVFLSAAQKKTQEEAIVKKEQQASELKRKYFGPEGELYKKRSDLMKPIQDEIWNAIKEIAKRNNYQMVLDRGTSGIIFASPSIDISDLVLSKMGFSK

SEQ ID NO: 318 - protein, 170 aa, Porphyromonas gingivalis
RINKQHEMKKFFLMLLMALPLSLLAQKVAVVNTEEIISKMPEQVAATKQLNELAEKYRLDLKSMDDEFAKKTEEFVKEKDSLLENIRNRRQQELQDIQTRYQQSYQTMQEDLQKRQQQLFAPIQQKVADAIKKVGDEENCAYIMEAGMMLYTGATAIDLTAKVKAKLGIK

SEQ ID NO: 319 - protein, 828 aa, Porphyromonas gingivalis
IMKEAIPRKNKYIKLNGIYRLSFILLCCLLCSQAAMAQGVRVSGYVLDRGEKPIPFAGVKVRGTGTGATTNLKGYYEFRMKATTDSITIEFSSMGYQGVSRSFPSLTKDTRLNVRLAEAEMELSSVTVQATKRRLNTMERVNTRDLRVNAGPTGGVESLISTYAGVTQNNELSSQYSVRGGSYDENMVYVNGVEVYRPLLVRSAQQEGLSFVNPDLTQSVQFSAGGFTADYGDKMSSVLDIRYKQPQEKEGAVLLGMLQSSAYYGSSAGAFSQITGVRYKSAKSLLGTTDTKAEYDPIYADGQTFMTYRFSPKLSVSFLGNISQTRYKFVPQTRETSFGTLSDAKKLKIFFDGQEQDRFLTYFGAFSMNFVPDDKQRHTVTLSAFNSNERETYDIQGEYFLNDVQLGADGTASMASGSENSNGLGIGRNHEHARNRLSYRVLNMGYRGEMKLNEKHRLQAGVSAQMEKIADHISEWERRDSVGYNLPHSETVLLMYNNLYADTQMRGTRLSAFVQDRFNFSMGGGTFSLIPGIRASWWSFNKELLVSPRISVGYSPESNPALVLRAAAGLYYQAPFYKELRQTHKDAEGNNVVVLNEKIRSQGAFHILAGADYTFEMGGRKYKFTAEAYYKSLFNINPYIIENVKIRYLGENIGSGYAAGIDLKLFGELVPGVDSWLTASIIKARQKLDGYGSLPLMNAPTYNFSFFLQEYVPGNKRITATLRAALSGGLPQLNPSKGLSSPAFTAPAYKRVDLGVMYKWLDPDDSFAGRSKWLMGVKGAYIGADLFNLFDMTNVNSYYWVSDAYQQQYAVPNYLTRRQFNLRLLVEF

SEQ ID NO: 320 - protein, 679 aa, Porphyromonas gingivalis
PIPFLLNMYSGHHKIHYPFLILLVCLAFAACKSVKLKDAEKAHDRQEYTKAADMYNTLYRRTRRKQVEMKAYTAFRSGENYRAAGRQAKALRGYLNARRYGYPDSVVLLRLAQTYQQGGNYKEAEVLFRGYLEAYPKSYFAAIGLEGCLFARQQKEYPTRYRIRRAAEWNSARGDFGPAYAPDASALYFTSSRSKDDGLDNSSITGLKPNDIYIIKRDAQGRWGRPDSVSGGINTPWDEGVPTITPDGSTIYYTLAQQGADYDRTVQIYSAARSGEGGWSNGSLVDIMRDSLRMAAHPSMSASGDYLYFVSNIGGSYGGKDIYRVKVSDRSYGSPENLGPDINTPGDEMFPFIDGDSTLFFASDGHAGLGGLDIFKATLDSTGQWHVVNMGQPVNSSADDFGLAVEPKGKNKEEALPDNGVKGVFCSNRGDARGWPHLFHFELPAIYTEIQGYVMDREENPIAGATVRIVGERGPVGQGFVTTRDDGSYKMSVQGDTRYVMLAGASGYLNQYVELKTDTAKQSETYYVDFFLASREKAEGLQNIFYDFDKATLRPESMKSLDELIRILTDNPDIRIELGSHADRKGPDAYNLGLSDRRAKSVVDYLTSRGIAADRLTWKGYGKSVPKTVTAKIAERHDFLKEGDVLTEEFVAPLTEEQQSVCDQLNRRTEFRVIEEELR

SEQ ID NO: 321 - protein, 772 aa, Porphyromonas gingivalis
PAQPKTYCIRYFRREVSPRRQTERTLYADKMRRHIVKCCPSASILLQEYSTTELFIHHFNISIIMKKFFFALLSIGISAQAFAKTDNVPTDSLRVHNLQTVTVYSTRTAVPLKKIPAKMELISSRNIKQSGFNNMTDILKTQSSLDVIQYPGFSSNIGIRGFKPSGKYVTVLVNGIPAGTDNISTLNTSNIEQIEILKGPFSSIYGTNAMGGVVNIITHKSKDKIHGNVSLFGGSYQTMAGSFNLGGRFEDIFSFDLSLGLDKQNKDYKTGSNNFLSLSKLEEAIVDVNATKNKKMKGSDYTVATGRLRFGIDFTPEWSLNLYQNVFLGDAIPVGGSIWGVYGESKKNLNRSSTSFELLGKHGCHTLQFSPYFNIEKSENYNNADPTGFINYKSDYYTYGALLQDKISFGGQNIVLGVDSRNMTMESERFEQAGVNTKPYNPGYATNNIGLFGQANFYLLNDALSISAGARADFMFFDLKANEYLNNEAKQETHNVINPNVGIKYEFVKGLTAHGTFGSAFSAPDAFQKAGQYVGPFGTTIGNPDLKPEKSMTWDFGIGYSNARCGIQADVTLTYFHTDHKDLILSSPDYANNITTYINADKARMSGIEALLSYDFGSLFANKFSLRAFANATIMLNSEMKKSQTDAPWSEMYYVRKQNITFGIEYRGKEGLEVMLNGRFMGRRIEQNWYAYYPEVRPELQQLLAAEEPELAAQGLLRHPQAMVFNASAYYHMNKYLTFGVNLNNILDELYTEKDGYHMPGRNIMGKVMVNF

SEQ ID NO: 322 - protein, 484 aa, Porphyromonas gingivalis
GRASSPYRQMDGILNDEYRQASMNRFSNHWPCILVGFVLWFVSASRTVAQNASETTVSYDTDTAVLSEADVLRIALSENATVKVADMDVRKQEYARRAARADLFPKVDLNGVYSHTLKKQVLYIDMPGFSSSEGIEMGRTHNTQGGVNVSMPLVSAQLWKSIAMTGEQLDLALEKARSSRIDLVAEVKKAYLSVLLAEDSYGVFKRSYDNALANYKNISDKFDRGLVAEYDKIRANVQVRNIEPNLLQAQNSVALALWQLKVLMSMEVETPIRLSGSLSDYKEQVYTGYFAADTLISNNSSLRQLDIQRRLAVSADKLNKYSFLPTLNLGGQYTYSLNSNDIKFWGEGQRWTPFSTISLSLYIPIFNGGKRLYNVKQSALSIRQIDLQRRHIEQSIRMGIKNQNDRLRTCMQRFVASEEAVRSAEKGYQIAEKRYQTGEGTLVELNDADVALLQARLNYNQAIFDFMTAKAELDKMNGMGIPEQ

SEQ ID NO: 323 - protein, 540 aa, Porphyromonas gingivalis
FHNFDFLNGIKLFSMANNTLLAKTRRYVCLVGFCWLMAMMHLSGQEVTMWGDSHGVAPNQVRRTLVKVALSESLPPGAKQIRIGFSLPKETEEKVTALYLLVSDSLAVRDLPDYKGRVSYDSFPISKEDRTTALSADSVAGRRFFYLAADIGPVASFSRSDTLTARVEEVAVDGRPLPLKELSPASRRLYRGYEALFVPGDGGSRNYRIPAILKTANGTLIAMADRRKYNQTDLPEDIDIVMRRSTDGGKSWSDPRIIVQGEGRNHGFGDVALVQTQAGKLLMIFVGGVGLWQSTPDRPQRTYISESRDEGLTWSPPRDITHFIFGKDCADPGRSRWLASFCASGQGLVLPSGRITFVAAIRESGQEYVLNNYVLYSDDEGDTWQLSDCAYRRGDEAKLSLMPDGRVLMSIRNQGRQESRQRFFALSSDDGLTWERAKQFEGIHDPGCNGAMLQVKRNGRDQVLHSLPLGPDGRRDGAVYLFDHVSGRWSAPVVVNSGSSAYSDMTLLADGTIGYFVEEGDEISLVFIRFVLDDLFDVRQ

SEQ ID NO: 324 - protein, 293 aa, Porphyromonas gingivalis
KSPSDSALPSVWSANTISGLVGGKRITLLILYSMAIRSSNIESIQCFVMKKEKLWIAIVAGLAFVLGLYALGRSVAQLRRSQPSVTVTGMAERNFKSDLIVWTASYQLQMMDLESAYKALKEKQILVADYLKNKQLPDSSYIFSSVAISKEYNYYYDPRQEQNVRTFAGYLLSQTVTVTSQDIEHVEKISRDITELINQGVEITSDRPAYYYTKLNDLKVEMLRNASEDAFNRASVIAEGSGSSVGKMLSSSMGVFQIVGLNSNEDYSWGGSFNTSSKMKTASITVKASFALK

SEQ ID NO: 325 - protein, 280 aa, Porphyromonas gingivalis
GKLQMKKTIAIIASALLALGAVGCKKNADTTAVSEKDSIALSMGILYGQDFANQFEMSRLQGQPIDSVAFLDGFKYGIDTTRFSYNLGAIYASNIARQLAHDSIDIDKFYAAMRAALLKDTVSIAMKPADAQAFMQRIQAKKQRENNMKQFGQNIEKGNEYIDTFKKEDGVTVTTTGLAYKTLQEGTGATPSLADTVRVKYVGTLVDGKEFDKNEEGIEFAVTGVIKGWTEMLQLMKVGQKVRVVIPQELAYGETGNYTIEPFSTLTFEMELIGIKPGKK

SEQ ID NO: 326 - protein, 803 aa, Porphyromonas gingivalis
CRKQKLSNPKRSRYPCRRISFRQSDKNPMKVLRQVFLPILFVLLTGACSTTKNLPEGEQLYIGMGKTQILRQDKSHAGQQALTEVESTLKVTPNGAIFGSASASLPKIPFGLWLYNSFVGDSTVISKWIFDKFAAKPVFISQVKSDSRAKVATNILREHGYFDAKVKSSVTTLKKDSLKAKISYTVDMASPYHYDSIIPLPISTFPDSILAYRQTPSLIRKGDQFNLAKLHEERQTISALLRDNGYYYFRPQDIIYEADTLLVRGAVCLRAKLSEDTPPQAMRPWRIGKRTAVLLGMNGESPTDSLEVEDMKVLYYRKMPVRPKILAKRFRFFSGNLYRQKDDETTRKSLARLGAFSVIDLNFLQRDSISGLLDVRLLTTLDKPWDASLETLFTSKSNDFIGPGLNFALARRNVFGGGENLSWNIGGSYEWETGNRPENSSNRLIDINSYNMNTAVNLSFPSIVFPGLLDKYYYYPTTTTFQASATALNRAHYFSMYSFGFSTTYEFQPSKEHRHAIFPLKLNYNLLGHQTETFQAITANNPPLLLSLQSQFLAQMGYIYTFNKSVSEKSPHHLWMQFGLSEAGNLLNLIYLAAGKKYSDTKNFVGVPFSQFIKATGELRYSYTIDRNQSLATRFGTGVIYSYGNMRVAPYSEQFYVGGANSIRAFTVRSIGPGRFNPDSDNQYSYLDQVGEFKLEANVEYRGKLFGDLHAAVFLDAGNVWLLREDSSRPGGALSEVGSVSNFLNSIALGTGVGLRYDLAFLVVRVDVGFGLHLPYNTGKKGYYNIPRFKDAIGFHLAVGYPF

SEQ ID NO: 327 - protein, 783 aa, Porphyromonas gingivalis
SLSPYIRFPMSSHSVRYLIGIAGCLLLMLASSCSVTRYVPDGSRLLDRVTIASETGSIALPEDIRDYTLQQPNYRLFGMTRWLLRVYSSSNPNSNSWWNRSLRKMGEPPVLIDSVLTDRTANRLAKAMAGDGFLDATARAVVDTGLYKKARITYLIQPGSRYYIRNMALDVKNPLLPPVALGNSLPSAYKVGISEGSPLSPIVLDEERKAIARHMRNNGFWKFSAEDVYYEADTTVSGGSGTKSADLKLVVNGIGRYPYRIGRVFFHADYDPLESDFRVQELPRIDSISRGDYTVYYGSRGRYIRASALTRSVSVTPGAFFCEDDVERSYIKLNALPIVRNVNIRFVEHNGKDEIALADSSRLVDCYILTVPAKSKSFEAEVLGTNSAGDFGAALSLGFTDRNLFRGAEMFNIKLKGAYEAIRKGSHSFMEYGVESSLRFPRLLFPFISDETRRRLRASTEWKIGYNYQTRPEFDRVILSAQLNYSWQTYLHNRLRHTIRLLDVDYLHLPYIDPDFAQSLPPTTALYNYTEQFILGSAYILNYTTASSMERTVSNPFTARFSIQTAGNLLQAISYLTDSPKDEHGLYKMFGLHYAQFVKLDLDLAKTVLLEKDNTLALHLGFGLAFPYGNARHIPFELRYFAGGSNSVRGWSVRTLGPGSMKMTPDKTFFDQMGDIRLDLNVEYRTKLFWKFRAAAFVDAGNVWTIKEYENQEDGLFRFDRFYKEIALAYGLGLRLDFDYFLVRLDAGLKAYDPQQTGRYKWAITRPNLSSNFAWHIAVGYPF

SEQ ID NO: 328 - protein, 875 aa, Porphyromonas gingivalis
  MOD_RES (392)..(392): Xaa can be any naturally occurring amino acid
VESKLLCLMRKRILQLFLTALLLALGSSLAIAQTVVTGKVIDSETSEPLIGVSVSTGQGASLRGVTTDMDGGFRFEVPAKSVLTFRCVGYATVTRSIGRGSQEDLGTILLDPQAIGLDEIQVIASVVPKDRMTPVPVSNIRVADIQAASLNVEFPELVKSTPSTYTTKGSGGFGDGRTNVRGFDTYNFGVLINGVPVNGMEDGKVYWSNWSGLMNQASTIQIQRGLGASKLGISSVGGTMNIITKTTDANTGGSAYVGMGNDGLHKESFSISTGMNDGWAITIAGSHMTGLGYVKGLKGRAFSYFFNVSKKFNERHTLSLTGFGAPQWHNQRSSKYSVADYDKYGIRHNQSFGYLRGELTPTAYAYNTYHKPQFSLNHFWKMDENTSLYTAXYASLATGGGRRAYGKNSKWVLINYNTGQPYEQTKVTPDGLIDYDAVLAANAAASNGSEAIFALGSNSHKWFGLLSSFKKKLNSSLTLTAGYDGRYYRGDHYDKITDLLGGSYYIEDPKTKLAYHAEGQQLKVGDIVNRDYTGEIMWHGLFAQMEHSSEWIDAFVSGSINYELYRNHNYGGSKSTGYLPGVSPWKSFLPWSGKAGLSYKFAQGHNVFANGGFFTRAPLFGNIYAAGAIIPNDKANMEKVLTGEVGYGFTNHKNFEFNINGYYTKWMDRVTSKRIGNEYVYLNGVDAVHCGVEAEVSYRPIRQIDLRGMFSLGDWTWQNNVSYTSYDEAGNETGQDITYIKGLHVGDAAQMTAAVSADIELFKGFHVIGKYNFLGKNYAGFNPATRNAQQYEADGKEIVESWKLPDVGLFDLSASYNFKLGSLSTTFYFNMDNVADKRYVSDADDNIIGKKHDEASALVWYGFGRTWSTGIRVNF

SEQ ID NO: 329 - protein, 460 aa, Porphyromonas gingivalis
NRCNPSRQYFHLSQNDVGRSLRAFLIHLSMKFSIRLFLCIIFLLSAFILPALGQKSKQVQRLEKQRKEALKAIEKTDRELRNTKKDKQDKQKHLNLLNKQVAQRKQMVQLLDNEVKELQSDIDSMTGVCHQLSVEEKARSDEYAQALQSMQKRKRSLDRILFISSAKSFDEGMRRMRFLEQYASAYKLASVRLRDTRSKLETERATVEDAKKEKGHLLVIREEEKKKLEGQQAEQRRQVQALGAKQKDLEAQLRKQKKQAEALNRKIEKQIAKEIEAAERRAREERERLAREAKAKGKPVPAEPERKAETKGGYAMDASERALSGSFAQNKGRLPGPVRGRYRIVSDFGVHQHSELKKVQVNNGGIDIAVATGSDATSVFDGVVSSVFVIPGYNSAVMVRHGNYITVYANLSKVYVNSGTRVKTGQALGRAYTDPSNNQTIIHFEIWKERSKQNPRLWLR

SEQ ID NO: 330 - protein, 342 aa, Porphyromonas gingivalis
SFYQEIDRLMKKYLLYASLLTSVLLFSCSKNNPNEPVEDRSIEISIRVDDFTKTGEAVRYERNQGSAAERLITNLYLLLFDQSGANPAKYYITGNTFTGGTWLPDDMKVKLDMTQSEAGERKVYVVANVDNAVKTALDAVANESDLQTVKRTTAMPWSTDIASPFLMSGNKTHDFLANRLLDNVPLVRAIAKVELNISLSEKFQIVPIIVNGSLSEFKFRYVNFDKETYVVKPTTKPDNLISSANGVWPQITDWTVWGASLNTSPAPDAGTGYTLDANGKVTALRIVTYLNERDSKGATVEVALPRVDDGTLPPPEFGPELYRLPLPDKILRNHWYKYEVEI

SEQ ID NO: 331 - protein, 329 aa, Porphyromonas gingivalis
NLRTQPFFLVDLQSMIRTILSRYVSSNFWSRGATFFFTIFPAFILAATALPACGGGTASGSDRTLAVTIEPQKYFIESIADKSVQVVALVPAGSNPEEYDPSPTVMKRLSEADAYFYIGGLGFEQRNLAAIRDNNPKLPLFEMGKALADAGSADLHGSCTDHSHTDLHAHDPHYWSSVVGAKALSRAAYDALVELYPNEKDKWDKGHDRLNGRIDSVKRLVDTMFANGKADKAFVIYHPSLSFFAQEFGLRQIVIEEDGKEPTAAHLRRVIDQARADGVRIVFIQPEFETRQAEDIAREIGARPVRINPLRSSWEEEILHIARALAHER

SEQ ID NO: 332 - protein, 878 aa, Porphyromonas gingivalis
ADSIRYPLYFFGRNRKKCFREPIPTLYNKNMIGKKIFFILLALIAFSGLNAATDTEFKYPTDANIIGHVKDSKTGEHLVGITIAIKGTTFGTSTDATGHYYLRNLRPGEITLIMRGMGYKSQERVVRVEKDKTIEVNFEAEEDAINLDEVVISANRELTLRRLAPTLVNVLNEKVFSQVNASNLAQGLSFQPGVRVENNCQNCGFNQVRINGLDGRYAQILIDSRPIMSALAGVYGLEQIPANMIERVEVVRGGGSALYGSSAIAGVVNIITKEPSHNSFTFNESLSFTGFSKLDNNTNFNASIVSDDNRAGAMVFGQARYRNHWDANNDGYSELGKIDARSLGAHSYLRLSDYSKLTGEFHTISEFRRGGDRIDLPPHVVGVAEQTDHSVFSGNLKYDLFSSNYKHHFQAYTSGQIVNRKSYYGGIGEIDVNGHPGGTEGYPIPQDQYGNNYGVTKGKTYMGGIQYSYDLDKFLLMPSQLLFGAEYTRDELNDVMPILSWQTGEDANGNTIPLYPELDQNINNYSLFGQNEWKNDRWSILVGARLDKHSEVKDMILSPRTTLRFNVNPDINLRATYAKGFRAPQVFDEDLHVGVVGGEAQKVFNDPNLKPEISHAFSLSADMYHRFGNVQTNFLVEGFYTRLLDVFTNEEQPDQHDGIKRYTRINGSGAKVFGLNLEGKVAYKSFQLQAGLTLASNKYDEAQEWGLNTVKDTNGAFVTEANANGQQEYKNESMTDTQITRTPSVYGYFTLAYNPAHSWNIALTGAYTGQMYVPHAIEYGVKSAELDIMQNNPEITDETGKAPRIDELKKTPAFFDLGLKVGYDFHVFQATEVQLYVGMNNIFNSFQKDFDRGAARDSGYIYGPTQPRTGYMGLVVKF

SEQ ID NO: 333 - protein, 206 aa, Porphyromonas gingivalis
KQIVMTVKRAVRIALLTLIGILFSSPSLVRAQSLFSTEHVLQLYNKILYGESAADTVAEKTAGESAFPFIDKLINLGRTFLGKPYRYRGPSPWPMDCSGYVSYLYSKFDIKLPRGAAAQSQYTNPIEREDVRPGDLLFFKGRNARSNRIGHVALVVSVDEDDITMMHSRNSRGIVIEKLNRSAYFSRRLVSYGRVPGAKRVIPRKS

SEQ ID NO: 334 - protein, 467 aa, Porphyromonas gingivalis
KGTWNRKNRREEMKRTILLTALTVLSSLSLLRAQNESEASTNPMSGLSLEDCIRIAKERNLNLRRQEIEQENRIISLDAARHSFLPSVNAGIGHNYSFGRSKDKTGVTVDRSSMNTNLSIGASVEVFSGTRRLHDLKQQKYNVEDGIARLQKAREDLSLQIAALYINLLFRQEMTRTAETQLALIREQRNRTAEMVRVGKWAEGKLLDINAQMAKDEQLLVQYRSEEELARLDLGQALELEHPESIAVKAPDTDVLVAERLGSLLAPEEIYRTALGLKPALHSSELQIASAREGLASARAAYFPTLSLSAGYSNGYFRDLGKEYAAINPSFSEQWKNNGSYSIGLSLNIPIFSAMQTQDRVRSSRLQIRSSELRLVEEKKALYKEIRQAYSNAVAADKAIAAAENSKAATLKAYEYARDSFEAGRLSAYEYAEAKTKYALSQVEELRAKYDFIYKAKVLDFYQGKDF

SEQ ID NO: 335 - protein, 451 aa, Porphyromonas gingivalis
KTSYRNNMRFQHYLICTAAVAALAANPLTGQSNMTLEECIDYARRHSSAVALSAAELEQSKADYLQAVGNFLPRVSAGTGASWNFGRGLDAETNTYTDINSFNNSYSIHATMTLFDGLQSVYRLRMAHARREASRLSVREQQELAALGTTEAYYDLVYARQMQELAMQKYEESSRLHRQTARMEELGMKSRPDVLEMQSRMAGDRLALTQADNQCIIALIRLKEKMNFPIDDELVVDDMPADSLSADMAESDSSAGVFARAAHHHPVLLRAKLDEQAATDRLRAARGAFLPSVSVSGGWNTGFSRFLNGSDYTPFSEQFRNRRGEYVSLNLSIPIFSGFSLVSHLRQARAERRAAIVRRGEAERRLYSEIAQAMADRDAALASYRQAKEHTDAMQTAYEAVLQRYEEGLNTAIDLTTQANRLLDARVQRLRAAMTYRLKCKLIAYYGCLSD

SEQ ID NO: 336 - protein, 962 aa, Porphyromonas gingivalis
AIFVVSLQIEKITENKYNSDKSMNKFYKSLLQSGLAAFVSMATALTASAQISFGGEPLSFSSRSAGTHSFDDAMTIRLTPDFNPEDLIAQSRWQSQRDGRPVRIGQVIPVDVDFASKASHISSIGDVDVYRLQFKLEGAKAITLYYDAFNIPEGGRLYIYTPDHEIVLGAYTNATHRRNGAFATEPVPGSELIMDYEVSRGGTLPDIKISGAGYIFDKVGGRPVTDNHYGIGEDDSDSDCEININCPEGADWQAEKNGVVQMIMVKGQYISMCSGNLLNNTKGDFTPLIISAGHCASITTNFGVTQSELDKWIFTFHYEKRGCSNGTLAIFRGNSIIGASMKAFLPIKGKSDGLLLQLNDEVPLRYRVYYNGWDSTPDIPSSGAGIHHPAGDAMKISILKKTPALNTWISSSGSGGTDDHFYFKYDQGGTEGGSSGSSLFNQNKHVVGTLTGGAGNCGGTEFYGRLNSHWNEYASDGNTSRMDIYLDPQNNGQTTILNGTYRDGYKPLPSVPRLLLQSTGDQVELNWTAVPADQYPSSYQVEYHIFRNGKEIATTKELSYSDAIDESIIGSGIIRYEVSARFIYPSPLDGVESYKDTDKTSADLAIGDIQTKLKPDVTPLPGGGVSLSWKVPFLSQLVSRFGESPNPVFKTFEVPYVSAAAAQTPNPPVGVVIADKFMAGTYPEKAAIAAVYVMPSAPDSTFHLFLKSNTNRRLQKVTTPSDWQAGTWLRINLDKPFPVNNDHMLFAGIRMPNKYKLNRAIRYVRNPDNLFSITGKKISYNNGVSFEGYGIPSLLGYMAIKYLVVNTDAPKIDMSLVQEPYAKGTNVAPFPELVGIYVYKNGTFIGTQDPSVTTYSVSDGTESDEYEIKLVYKGSGISNGVAQIENNNAVVAYPSVVTDRFSIKNAHMVHAAALYSLDGKQVRSWNNLRNGVTFSVQGLTAGTYMLVMQTANGPVSQKIVKQ

SEQ ID NO: 337 - protein, 702 aa, Porphyromonas gingivalis
WKKSNPQYRGRTANYRDHYNTESYLSLRRNQTMKYLIRLFLSLMLLSLWTGCTHEELSICDGENTLVLRVETGKAPNARATEPGQGIYNENKVGSISVLFYLEGQLRWQVKSTDYQIHEGAYIIPVKEQMRPLFNGNNNFSIYVVANLDFNAPATEAALSQFVVEKSIEVSSTTAPADFVMLAHGNKQINMATTEGKLLGDYKLKRVAAKIRMIKPTINVQGYEVVGNIQAKFRNSVTKGFLTTEAQEIPAAASYKTSEYLDIAESAPANSIHFYSYYNKWTLSTPEKRPEFFIMVKFKKTGQPDNTAKPYYYRVPLESQDNQVKSNVLYNLNVKIEILGSLQEPEAVSVNGTLAIEEWILHQDAFNLPATNYLIVEQHEIFMNNVNTYSVKYQTSQKPISISIQSVTFSYVSSDGTQHNDLVASSSDQYPTITSDNTSIIITSKIPVNNVPKKIVFEVTNGVAGLKETVTVLQYPAQFIVNTLGTASAWRPDGSLAPGLNNKAIYHVVVLVPPENLFEDGTQTIIGYPPTETISFHKKENNTYPIVWSDTNTTKQDLETSRMISPSFELASQLGATLPMPYLEYWPGTSYLLDYSGNYNNKRYALFNCAFYWEKRKVNNEEIKFDDWRLPTEAEIKLIDKLQHNEQSAVQAIMTGNYYWDSYSANGSYKMQGGGGQGNSSKAYVRCVRDVKKPIRDKKSGK

SEQ ID NO: 338 - protein, 1312 aa, Porphyromonas gingivalis
KRVDSYECRQKACKCAICVIQKFTNVKLNDMRKILSFLMMCSLHLGLQSQTWHGDPDSVAALPSIGIQESSCTRITFEVVFPGFYSVEKREGNQVFQRISMPGCGSFGNLGEAELPVLKKMIAVPEFSTANVAVKIKETETFDNYNIYPNPTYVVEELPEGGTYLVEAFAINNDYYSQNVSLPSTHYVYSQDGYFRSQRFIEVTLYPFRYNPVRQEILFAKKIEVTITFDNPQPPLQKNTGIFNKVASSAFINYEADGKSAIENDMVFSRGTTTYISGNVASNLPQNCDYLVIYDDMFNVNQQPHDEIKRLCEHRAFYNGFDVAAVSIKDVLNSFPSNATSYINETKLKNFIRSVYNQSNAKRTLDGKLGYVLLIGKPLSKYLADTDNTKVPTSFIHNVSLIPSHPTFGSICASDYFFSCVSPLDTVGDLFIGRFSVTNAHELHNLIEKTINKEISYNPIAHKNILYAEGKGCDAPILRLFLKEIASGYTVNSILKSNQVSAIDSIFDCLNNGSHHFYFNTHGMPTVWGIGQGLDVNTLTARLNNTSSQGLCTSLSCSSAVADSTIRSLGEVLTTYAPNKGFSAFLGGSRATQYAVYLEGPCPPSEFYEYLPYSLYHNLSTVVGEMLLSSIINTNSVDTYSKFNFNLLGDPALNIMAHGMEVSNCITLPNNTIISSPITIKNGGCLKIPEKGVLHFTNNGSIQVMSGGTLEIGNQAKISGETGANPTFITVYGDGLAINKQVEIDNIDRLNLFSTHSVMPKFHFDSVKFNSAPLYTTNCIVEISNCEFTNRSDIISKNCDLSVENSMFSSSGITVFKPMATSSITGLSTKAKITDNTFFATGNFAYHITNTPGLTATSNAAIKLDNIPEYYISGNKIVNCDEALVLNNSGNRTNRLHNITRNVIKNCRIGSTLYNSYGIYNRNKISNNHIGVRLLNNSCFYFDNAPVINEEDKQTFISNRTWQLYSSNGTFPLNFHYNSLQGGDTDTWIYNDTYTNRYIDVSNNHWGNNDLFDPNQVFNTPDLFIWIPFWDGLPNGRSGNSSAEAVEFQTALDCIGNSDYLSAKVALKMMVETYPESDFAIAALKELFRIEKMSGNDYEGLKDYFRSNPTIISSQNLFPTADFLSARCDIVCENYQSAIDWYENRLNSEISYQDSVFAVIDLGDIYWNMQLDSLRGTGIDLNILSCEQRKSLESHQNVKNYLLSTLPESTGTLLPPLECNKSSLDKSKIISISPNPAKAVVTIIYYTDNPSCSVIKIYGINGASADITGLPKHLSEGYYSIQFNTSNFDPGFYLVTLNVDQKIIDTEKLRIK

SEQ ID NO: 339 - protein, 938 aa, Porphyromonas gingivalis
SENYRYGKITNQIMAIMMKSIVFRAFLTILLSWAAITNPTAQEISGMNASCLAAPAQPDTILYESFENGPVPNGWLEIDADADGATWGSPSGSFSVPYGHNGLCTYSHIRSGISTAGNYLITPNIEGAKRVKYWVCNQYSTNPEHYAVMVSTTGTAIEDFVLLFDDSITGKPTPLVWRRRIVDLPEGTKYIAWRHYKVTDSHTEFLKLDDVTVYRSIEGPEPATDFTVINIGQNVGRLTWNYPEDYQPEGKGNEELQLSGYNIYANGTLLAQIKDVSILEYVDSTYSLRDNPLQVEYCVTAVYDESIESSTVCGTLHYATDAILYENFENGPVPNGWLVIDADGDGFSWGHYLNAYDAFPGHNGGHCSLSASYVPGIGPVTPDNYLITPKVEGAKRVKYWVSTQDANWAAEHYAVMASTTGTAVGDFVILFEETMTAKPTGAWYERTINLPEGTKYIAWRHYNCTDIYFLKLDDITVFGTPASEPEPVTDFVVSLIENNKGRLKWNYPNGYEPDKTDDKDPLQLAGYNIYANGSLLVHIQDPTVLEYIDETYSSRDDQVEVEYCVTAVYNDNIESQSVCDKLIYDSQSDIILYEGFEAGSIPEGWLLIDADGDNVNWDYYPWTMYGHDSEKCIASPSYLPMIGVLTPDNYLVTPRLEGAKLVKYWVSAQDAVYSAEHYAVMVSTTGTAVEDFVLLFEETMTAKANGAWYERTITLPAGTKYIAWRHYDCTDMFFLLLDDITVYRSTETVPEPVTDFVVSLIENNKGRLKWNYPNGYEPDKTDDKKPLQLTGYNIYANGSLLVHIQDPTVLEYIDETYSSRDGQVEMEYCVTAVYNDNIESQSVCDKLNYTITSLDNIQSDTSLKIYPNPASYVVRIEGLSRSKSTIELYNALGICILREETHSEKTEIDVSRLNDGVYLIKVVGGNKTTTEKVEIKRP

SEQ ID NO: 340 - protein, 606 aa, Porphyromonas gingivalis
IIFCTIHHSELEIMNSIMKYQLYTAVIMALSVSSVCGQTPRNTETKRPDTLRRELTIVNDQTVEMEHADPLPAAYKAIEPRLKPFRPEYNKRTFGFVPEVSSSGRNNLPNILPTEGHMKHRGYLNIGIGHTLNQRMDAGYRLIDAEQERLNLFLSYRGMKSAFNTGDFDGDRKDRRMMAGVDYEQRRPSFVLATGLYYSNHYFNNYGRGATTNVGSIPQLSTPVTPQMDNGTHNVRVYLGAKNDVIDARIDYRFFRSIPYLGTDPMKALTEHTPELNVTMSNELSDDIKLGVEVRTGGLFFAKNSEMIQTGVLSETDRNLYYVEGAPTIGFVGDSDNMQWNIQAGVGISSHFGAKGRLFFWPKLDASLSIFPSWRVYAKAFGGVIRNGLADVMQEEMPYLMPNTIVLPSRNALTAQLGVKGNIADVVRMEVYGDFSKLTGVPFYTPTLPLYNPSDLYQYNVSFLPIYADGSRWRAGGKLEYSYRDMLRFLVDASYGKWNLDGGLVASMQPDLILKAEVGVHPIAPLDVRLRYTQLNGRYRYSFGSAGSEALGIGNVHLLSADVSYKLKKNLSLYLKIDNMLAETTELIGYYPMQPFHCFAGFSWTF

SEQ ID NO: 341 - protein, 357 aa, Porphyromonas gingivalis
NSHATVSVICSMMEKCIFAHYPHNLVFMIRKHFGIILGFLSLVFSAGAQQEKQVFHFLNLPATAQALAAGGKAITIVDDNPGLAFENPALLGYESGGRAFLSYLYYMSGSHMGNACYASSVGERGMWGVGMRFLNYGSMQGYDQNAIATGSFSASDIAVQGFYSHELSNHFRGGVSLKALYSSIETYSSFGLGVDVGISYYDDDKGYSASALFKNVGAQLKGYNEEREPLDWDFQLGFSRSFINAPFRLHITLFNLNPHYFKRLVPRDLSKMQKFLRHFSIGAEFTPSERFWVGLGYTPQIAQDFEVEGGNKWGGLSAGVGFTSGVVRVGVSAATYHPAALSFMCSVGIRLDDKSIF

SEQ ID NO: 342 - protein, 337 aa, Porphyromonas gingivalis
PQPVGLKEITIKPMCLEPIIAPISSELLEQELTADRFLRMTNKAGNEIYVFTAEEAPHCMKEVGRLREEAFRHYGGGTGKAIDIDEFDTMPGSYKQLIVWDPQNKAILGGYRFIYGRDVAFDTDGKPLLATAEMFRFSDAFLHDYLPYTVELGRSFVSLQYQSTRMGTKAIFVLDNLWDGIGALTVVNPEALYFYGKVTMYKDYDRRARNLILYFLRKHFSDPEGLVKPIHPLPIEISAEDEALFSSSDFDTNYKTLNIEVRKLGINIPPLVSAYIALSPEMRVFGTAVNESFGEVEETGIFIAVGKILEEKKQRHIESFILSRNEKKGLDSSNGRS

SEQ ID NO: 343 - protein, 566 aa, Porphyromonas gingivalis
YDGARLVYTLFRNRNDIHPMKTIVRYSRLPVALFFCLLGAVHLSVEAQMLNTPFELSDQIVLSPTERQYREICVQTKEKRGADLFPLSDKLRDSAYVRFGSAYGDIAGDYLPYNGNNYSSLSLESGGRISVRNYGTLQGSASYSRGMHKRIGWNALRNAEAYYPYLVSDSTGGDYHFEDYRLAGYYSFRAGRLPLGIGFSYRGEVAYRLTDPRTTNTTGALELSCATSLTLPRENRLSLSAAYLYHRQHLTQYNWRPGQQDKFFVSYGFGQVDVSNSPIWFGISRMNYVNGWKLSSRLDTRRGDAIGLDYSGYFLDTEERSSINLFALLYNRLRLYGSWHLSDFDFSFSADYALRQGIERIYEDYKPDDNYHIYDLRILAIRRWYMLNEFSAQAQASYRIRTDRGCALRVSAGSDFYGYDETYRKHGHHTMSGMLRPFAGIAYDHAGSKLDFGLSLSAAYRMVLTHSYKIRTIQKEQLDYQLAYLPYAYRNREGVEVRSSLYVSIPMQNTHRLMTELRLYGDLMKRKDGIAYGKTPGVISHILSDPQAERTSGHTIGAICNISYLF

SEQ ID NO: 344 - protein, 819 aa, Porphyromonas gingivalis
RTNVFLSLSHKIGRRGASCSNRNAWMAENKPSSPEPDNTGVGNSPSDYLHGEAIIPPLSSLSNFNDKRFMKKLHMIAALAVLPFCLTAQAPVSNSEIDSLSNVQLQTVQVVATRATAKTPVAYTNVRKAELSKSNYGRDIPYLLMLTPSVVATSDAGTGIGYSGFRVRGTDANRINITTNGVPLNDSESQSVFWVNMPDFASSIEDLQVQRGVGTSTNGAGAFGASVNMRTDNLGLAPYGRVDLSGGSFGTFRRSVKLGSGRIGRHWAVDARLSKIGSDGYVDRGSVDLKSYFAQVGYFGSNTALRFITFGGKEVTGIAWNGLSKEDEAKYGRRYNSAGLMYVDAQGVPHYYHNTDNYEQRHYHAIMTHSFSPSVILNLTAHYTAGYGYTDEYRTGRKLKEYALQPYVENSVTVKKTDLIRQKYLDNDFGGLIGSLNWHTGAWDLQFGASGNIYKGDHFGRITYIKKYNQPLAPDFEYYRNRADKREGAAFAKANWQITPELNMYADLQYRTIGYTINGITDEYDEVQGSMQHIDLDKTFRFLNPKAGLTYSFDDAHTAYASVAVAHREPNRTNYTEAGIGQYPTPERLIDYELGYRYASPLLSAGVGLYYMQYKDQLVLDGRLSDVGQMLTSNVPDSYRMGLELTLGWQILPRLLRWDASFTMSRNKIDRYVQYTSVYDADYNWLELKEETLESTDIAYSPNVIAGSMLTLSHAGFEMAWTSRFVSKQYLDNTQRSDRMLSSYWVNDLRLGYVLPVHFVKRVALGVQLNNLFNLMYASNAYIYDAGYVQASGELSAYADLRYYPQAGFNALGSLTIDF

SEQ ID NO: 345 - protein, 532 aa, Porphyromonas gingivalis
YRRSGRVCPRILRNKRSYADTRLQPRRAVRLRAGTRTKMKRRFLSLLLLYILSSISLSAQRFPMVQGIELDTDSLFSLPKRPWRAIGKTIGVNLAVWGFDHFIMNEDFADISWQTIKSNFQTGFGWDNDKFVTNLFAHPYHGSLYFNAARSNGLSFRHSAPFAFFGSLMWELLMENEPPSINDLCATTIGGIALGEMGHRLSDLLIDNRTTGWERMGREVAIALINPMRFLNRLTAGEVTSVGSRSGQIFQSVPINIVVDAGFRFLADKRHARTGATALTLNLRFDYGDPFRSETFSPYDFFQFKAGLSFSESQPLLSQINLIGILSGCQLLAHERTVLVGGLFQHFDYYNSEKRISKNSEEVLVTPYRISQVAALGGGLIFQHHGKFRRRPLELYAETYLNVVPMGASLSDHYNVDNRDYNLGSGLSGKLYLGATYNDLWSWLLGVESYRLYTWIGYEEPHQKNTDVSSFMVQGDESKARLLVTSSEFAFHPGPWHVAIVARRFIRKTAYQFYPNVSFDTGDIQLRVGFHF

SEQ ID NO: 346 - protein, 300 aa, Porphyromonas gingivalis
KRRKKQMKRLIVFLAMGGLLFTLANAQEANTASDTPKKDWTIKGVTGLNASQTSLTNWAAGGENTVAGNLYLNIDANYLKDKWSWDNGLRTDFGLTYTTANKWNKSVDKIELFTKAGYEIGKHWYGSALFTFLSQYAKGYEKPSDHLTGVKHISNFFAPAYLTLGIGADYKPNEKFSLYLSPTTGKLTVVADDYLSSLGAFGVKVGEKTMFELGALVVGSANINLMENVNLITKASFFSAYTHDFGNIDINWEAMLAMKINKFLTATIATNLIYDDDVKINDGPKIQFKEVVGVGVAYTF

SEQ ID NO: 347 - protein, 221 aa, Porphyromonas gingivalis
TRESVLHCRTKLKKERKMKKMILAATMLLATIGFANAQSRPALRLDANFVGSNLMQKVANTSVNNKMIVGLRVGAAAEFALSNDGFYLAPGLAYTMRGAKMESLSETTTRLHYLQIPVNAGMRFSFADNMAISLEAGPYFAYGVAGTIKTKVAGVTASVDAFGDNGYNRFDLGLGLSAALSYDRYYVQIGYEHGLLNMLKDAPDKTSLRNHDFFVGLGVRF

SEQ ID NO: 348 - protein, 248 aa, Porphyromonas gingivalis
IKRIEMKRIFTVALVLLASVTMAIGQSRPALRVDANFVGSNQSMKRDGYVWDTKMNVGLRVGAAAEFMIGSRGFYLAPGLNYTMKGSKTEWDIPEMVPGTYITMVSTRLHYLQLPINAGMRFDLMNDMAVSIEAGPFLAYGIYGTYRQKLEGWKPNNYSTEFFGPTLGGPTNIRWDIGANIIAAFHYKRYYIQIGYEHGFVDIVSGGGSDIPRLNDNRQSSSTTALREKGNNEYAYNRDFFVGIGYRF

SEQ ID NO: 349 - protein, 211 aa, Porphyromonas gingivalis
KRKSMKRMLLLLVVLLYGIAGRLAAQDVIRPWSLQVGAGYSDTENIPGGFTYGFYLGKRMGSFLEVGLSMYNSTRQTANNADSFASNEGDGSFQVNMSSPNEKWSFFDAGSANCYMIVVGVNPLHLFWQNSRHNLFLAVQAGLSNKHNIHFIYGDKGAKVSIYTNSNTYIGYGARVAYEYQIHKNVGAGAAVMYDHGNKMLTAMATLSTHF

SEQ ID NO: 350 - protein, 953 aa, Porphyromonas gingivalis
IRMRVSDLCSRLSWLLPVILVGLLCATLVAAERPMAGAVGLHHRRHAALSDSTAKDTVPLAKPIPDSAFRDSLPADSTGSMRQDSVYDDEFELEDIVEYEAADSIVLLGQNRAYLFGKSYVSYQKSRLEANFMYLNTDSSTVYTRYVLDTAGYPMAFPVFKDGEQSFEAKNFTYNFRTEKGIISGVITQQGEGYLTAGKTKKMPDNIMFMQGGRYTTCDNHDHPHFYINLSKAKVHPEKDIVTGPVNLVIADMPLPIGLPFGYFPFSNKYSSGILMPTYGEDNRYGFYLRNGGYYFAFSDYIDLALRGEIFSKGSWGISAQSKYKKRYKYNGSFEANYLVSKSGDKYVPGDYSKTTSLNIRWTHSQDPKANPLQTLSANVNFATGSYFQNSLNTTYDVNARTATTRSSAVSYSRKFPGTPFSITGSMDISQNMRDTTVSLTLPNLSINMSTRYPFKRKTRVGPERWYEKLSVGYSGQLRNSILTKEKDLLQSNLVRDWKNGMRHSVPISLTVPLLDYINLTMGVNYNEWWYTKGIRKSWNEDKKTFLPSDTTYKFRRLYDYSLSAGLSTTLYGMFKPWKPFSFGGNLIMIRHRFTPTVSFSYMPDFTKRRYGFWELLEHTDQNGKLHTLLYSPYFEQIFGAPSMGNAGSVNFSFDNNLEAKIKSKSDSTGIKKISLIDQFTWSTSYNMFADSIRWSNISASLALRLSKSFTLRLSGLFDPYLTKYYEGEDGKIIPYKSNDLRIFNGKGLARLISTGTSFSYTLNKESLSGLIALFSGKKERRDEKKNTGATPHEGDDAADILEGGRPQNESGGSLLERNRQGGAVDQDGYFAYSIPWSLSFDYSWNIATDYNRYNVNKMEHYYRVTQNLSFRGNIQPTPNWSFGFNANYNFDLKKITSLTCNVTRDMHCWAISASFIPIGAYKSYNFVISVKSSLLQDLKYQQSNRPITNTWY

SEQ ID NO: 351 - protein, 1251 aa, Porphyromonas gingivalis
  MOD_RES (1008)..(1008): Xaa can be any naturally occurring amino acid
KWKLACAFDCACCFDPFVVTNEVIIMMKRYTIILAVFLLFCTVFTFQIKARPYERFADVEKPWIQKHSMDSKLVPANKGNLIQAEIVYQSVSEHSDLVISPVNEIRPANRFPSHRKSFFAENLRASPPVVPVAVDKYAVPVANPMDPENPNAWDVTLKITTKAVTVPVDVVMVIDQSSSMGGQNIARLKSAIASGQRFVKKMLPKGTATEGVRIALVSYDHEPHRLSDFTKDTAFLCQKIRALTPIWGTHTQGGLKMARNIMATSTAVDKHIILMSDGLATEQYPVKNVTTADFIGKTGNANDPIDLVIQGAINFPTNYVSNNPSTPLTPNYPTHSSKVGRRNLPESKFDYSNLSARITFDGVAGALVYEPRFPHPYYYYFPCNAAINEAQFAKNSGYTIHTIGYDLGDFALANNSLKLTATDENHFFTATPANLAAAFDNIAQTINIGIQRGEVTDFVAPGFIVKNLTQSGDVTHLLNVSNGTVHYDVSTKKLTWTTGTILSSSEATITYRIYADLDYIQNNDIPVNTTSAIGPDLGGFDTNTEAKLTYTNSNGEPNQQLIFPRPTVKLGYGVIKRHYVLVNKDGQPIQANGTVVSSLSEAHVLQSQDFFLPSGGGHIVPKWIKLDKTTEALQYYSVPPTNTVITTADGKRYRFVEVPGSTPNPGQIGISWKKPAGNAYFAYKLLNYWMGGTTDQQSEWDVTSNWTGAQVPLTGEDVEFATTENFGSPAVADLHVPTTNPKIIGNLINNSDKDLVVTTSSQLTINGVVEDNNPNVGTIVVKSSKDNPTGTLLFANPGYNQNVGGTVEFYNQGYDCADCGMYRRSWQYFGIPVNESGFPINDVGGNETVNQWVEPFNGDKWRPAPYAPDTELQKFKGYQITNDVQAQPTGVYSFKGMICVCDAFLNLTRTSGVNYSGANLIGNSYTGAIDIKQGIVFPPEVEQTVYLFNTGTRDQWRKLNGSTVSGYRAGQYLSVPKNTAGQDNLPDRIPSMHSFLVKMQNGASCTLXILYDKLLKNTTVNNGNGTQITWRSGNSGSANMPSLVMDVLGNESADRLWIFTDGGLSFGFDNGWDGRKLTEKGLSQLYAMSDIGNDKFQVAGVPELNNLLIGFDADKDGQYTLEFALSDHFAKGAVYLHDLQSGAKHRITNSTSYSFDAKRGDSGARFRLSYGCDENVDDSHVVSTNGREIIILNQDALDCTVTLFTIEGKLLRRLKVLAGHREVMKVQTGGAYIVHLQNAFTNDVHKVLVEY

SEQ ID NO: 352 - protein, 426 aa, Porphyromonas gingivalis
TMEVKKNTVVLRLLIWFVAILLFHSSRLWGQEGEGSARYRFKGFVDTYHAVRSSSPFDFMSSRTRVRGELERSFGNSKVAVSVNATYNALLKDETGLRLREAFFEHQEEHWGLRLGRQIVIWGAADGVRITDLISPMDMTEFLAQDYDDIRMPVNALRFSVFNESMKVEVVVLPVFEGYRLPVDPRNPWNIFSLSPIAQGMNIVWKEEAGKPAFKVANIEYGARWSTTLSGIDFALAALHTWNKMPVIEVQGIVPTEIIVSPRYYRMGFVGGDLSVPVGQFVFRGEAAFNIDKHFTYKSHAEQEGFQTINWLAGADWYAPGEWMISGQFSMESIFRYRDFISQRQHSTLITLNVSKKFFGSTLQLSDFTYYDLTGKGWFSRFAADYALNDQIHLMAGYDWFSSKGSGIFDRYKDNSELWFKARYSF

SEQ ID NO: 353 - protein, 464 aa, Porphyromonas gingivalis
YGKRRKLGTSVRPSVLTQIRFILDLHLITDFFEGLRVNPIGAAAIVAFIIDLLLLCCSAFMSSCEVAYFSLKPIDLQNIRERNHSSDIALSNLLDNSNQLLATILIGNNVINVAIVILSNYAIEQTFVFSSPIIGFLIQTILLTTVLLLFGEILPKVYARKNPLQYSRFSAAAMSVIYKILSPFSKLLVKSTGIVTRGISKKKYDMSVDELSKAVALTTTEGEPEEKEMINEIIKFYNKTACEIMVPRIDIVDVDLSWPFRKMLDFVVSSGYSRLPVSEGSEDNIKGVIYIKDLIPHMDKGDEFDWHPLIRKAYFVPENKRIDDLLEEFRANKVHVSIVVDEFGGTCGLITMEDILEEIVGEITDEYDEEELPFKVLGDGSYLFEGKTSLSDVRHYLDLPENAFGELGDEVDTLSGLFLEIKQELPHVGDTAVYEPFRFQVTQMDKRRIIEIKIFPFERTWEVE

SEQ ID NO: 354 - protein, 266 aa, Porphyromonas gingivalis
IIYRSTMKLLLYLLLVLSTLSPMYSQMLFSENLTMNIDSTKTIQGTILPVLDFKTEKENVFTFKNTANLNLLIKHGQVINLINKLEFSTYGNKVTVSGGYVHTEYRYLLHHVFEVYPYVESQWAESRGMKYKVSTGLQSRYRLVNSDNCLMFATLGVFFEFEKWEQPATSLFAGTYAYSRSIKSHLSISFRHRLGEHWEFTTTAIHQGKPDSYFKKARFGGAIDLKYHITPTIGIRGAYRIIYDTAPIVPVRKDYNTVDVGIDISF

SEQ ID NO: 355 - protein, 907 aa, Porphyromonas gingivalis
TICVAFLSAPVAALRESPPMGAERKTPSLLPLLFEHSDKGKGFDYRLFTSNKLKVFATGNSRYIHNKPTIIQAMKRIVLSSFLFVLSILSLMAQNNTLDVHISGTIKDASSGEPVPYATVSIRLTGADTTQVFRQVTDGNGYFVIGLPAAPSYHLTASFVGMKTHTMQISRGNGQHDIKSIDISLESEDKQLSTVTVSAARPLVKMEIDRLSYNMKDDPAAKTNNLLEMLRNVPLVTVDGQGNIQVKGSSNFKIHLNGRPSTMVSSNPKEVFRSIPAHTIKRVEVITDPGVKYDAEGTSAILDIVTEEGKKLEGYSGSITASVSNNPTANGSIFLTAKSGKVGLTTNYNYYGGKNKGSRYFTERTTSMLQTIEEGKGQETFGGHFGNALLSFEIDSLNLFTVGGNVRLWEMTTDRNSVEKSFAGSNLMSYIDRKLKTQMDAGSYELNADYQHSTRLPGELLTVSYRFTHNPNNSETFIDQWKRDPLNTANTIQYAGQHSKSDAGMDEHTAQVDYTRPLGQAHSLEAGLKYIYRHATSDPLYEIRPSEDAPWQPGSLYAQNPSNGKFRHDQYIGAAYAGYNYRKDQYSLQTGLRVESSRLKALFPENAAADFSHNSFDWVPQLTLGYTPSPMKQLKLAYNFRIQRPAIGQLNPYRLQTNDYQVQYGNPDLKSEKRHHVGLSYNQYGAKVMLTASLDYDFCNNAIQNYTFSDPANPNLFHQTYGNIGREHSFSLNTYAMYTPAVWVRIMLNGNIDRTFQKSEALGIDVNSWSGMVYSGLMFTLPKDWTVNLFGGYYHGGRSYQTKYDGNVFNNIGIAKQLFDKKLRVSLSANNIHAKYSTWKSRTIGNGFTIYSENAGIQRSVSLSLTYSFGKMNTQVRKVERTIVNDDLKQTSSQGQQGGGQGNPTGN

SEQ ID NO: 356 - protein, 450 aa, Porphyromonas gingivalis
WCQSDPIPHCHAVYRNAQGHQQGRSDQDRLPPVRGYRYARCLGRYEGFGERMRLSAILIALIVMLPAVLSGQHYYSMAGERLETDSIRPNELSASIRSALFFRNNEYNARSVKGYTLPGARVSAFASYSLPAAHGVKLSLGVSTLNYWGASRYPAGIAYSDLPYWTDYNDYVRLRILPYVQAMLKPTATTALMLGNIAGGTAHGLIEPIYNPELDLTADPEAGVQFRGDWTRFRMDVWVNWMSMIFKNDNHQESFVFGLSTTSKLLSGEGKWRLELPLQAIATHRGGEYNWAQQDTVHTWVNGAVGLKLSYRPRTDKPMQIWGSAYGVAALSSGGYFPYERGWGGYLSLGMDLEHFAFRTDYWYGRHYVSPFAAPFANSLTYDKQPLTNGWGDYIRLYADYSWRMARSVSLAAVARVWFQPSDRFAMSHALELTMRIDPKFPIAFLKGNH

SEQ ID NO: 357 - protein, 447 aa, Porphyromonas gingivalis
PFSPPWVCAGAASSVRTRPCSTVSSTAASSHRRSEHMRSADSSPAYSPIGSLSSSHSFDSIPDQRMNKSLLSLACLILCGMPAIAQQTGPAERSGEPSLAERVFGLEQKQKKLKVYLGIQSFYDQPLVDDESHIGHFKVQELRMSAHGELNRHLSFDWRQRLNRAADGTSFADNLSNAIDIAGVDWHPNDKVSFFFGRQYARFGGIEYDMNPVEIYQYSDLVDYMTCYTSGVNFAWNFHPEQQLQLQVLNAYNNRFADRYHVTPDVATATSYPLLYSAQWNGTLLGGALHMRYAVSMAHQAQERNMWYFTAGNLFNPGKRINGYLDLTYSIEGLDDKGIMTARYGKGKTLTDVKYYALVSKWNFRIFDQVNLFLKGMYENGYAPAQYGESSHTRHSYGYMGGVEYYPTETNFRLFVTYIGRHYRYSATETESTNALRAGLIYQIPFL

SEQ ID NO: 358 - protein, 227 aa, Porphyromonas gingivalis
  MOD_RES (180)..(180): Xaa can be any naturally occurring amino acid
YKQAIMKHLFKSTLVLLCALSFSGTYTFAQENNTEKSRFDFSVRLGQGYIAGSTTNLMYGYTSANDRLLSGAIYLGLTPSKKENATGVAFRFLSPSPGYYVDISGKENTLNYAFYVVGAYNRIAIPIRPIKNFNFIFSTEVGMAWMSRHEQIYNSTSQTWDKQRKSRSGLDFGLGMHLQXHINKTVYFMAGTDLTSCMFGKRINDYQQKDRTFIALIDNSIGIGLNL

SEQ ID NO: 359 - protein, 406 aa, Porphyromonas gingivalis
IFIDPDKNTKQNERNMIIKKMLKNKLAPLAILFLFAPKAMKAQEQLNVVHTSVPSLNISPDARAAGMGDIGVATTPDAYSQYWNPSKYAFMDTKAGISFSYTPWLSKLVNDIALMQMTGFYKLGTDENQAISASLRYFTLGKLETFDELGESMGEAHPNEFAVDLGYSRQLSENFSMAVALRYIRSDQSTHNTGENQAGNAFAADIAGYLQKYVLLGNAESLWSLGFNVKNIGTKISYDGGVTSFFIPTSLNLGTGLLYPIDDYNSINFNLELSKLLVPTPPIMDQNDQAGYEAALKKYQETSSISGIFSSFGDAPGGLKEEFREITWGLGAEYSYDDKFFVRAGYSYLHPTKGNLQYFTAGAGFKMNIFRIDASYLLSTIQSNPLDQTLRFTLAFDMDGLRNLFH

SEQ ID NO: 360 - protein, 452 aa, Porphyromonas gingivalis
LIIEKEMKTTVQQIILCLALMMSGVLGGNAQSFWEEIAPPFISNEPNVKYIIPNMGIDSKGTIYVTVTKRIQQGANYTSEQLGMYYRPLGDNEQWWKHDPYFDDKIVADIQTDAYGRVYVCTTSSRDQEYQLYINEQNEWRCIFKTSVSTYEHGMAVFRSSTGVTYIGTRHHIFASGVNDFEFNTIYEDSTPMSCRFAEATNSGTIYLALMHETTMSTTILTYQNGEFVDISESELSNSIIASMCSNKEGDIIALVTSYTGFMSGTLAIRKADEGKWQLVGGDIQNAIVQNICMMDDNKIACEVFGTPNGVDGRTRVCVSDASVFDFEWYEDEIYGGLIFDTFFYSPWDKLLYAKFGGIMLRSKESFITSFISPTVVQGVDVYTLAGKIRIESETPVSEVLLFDLAGRMVLRQTIDNKIYSDIDTNGLKRSGIYVVSVRLSSGQVFSHKVQV

SEQ ID NO: 361 - protein, 331 aa, Porphyromonas gingivalis
GLYGMSVVPIIIYLCGISNYARLMIIRCLIRRPRTVLFGLIFVVGLFSAMAQEKKDSLSTVQPVPNSSMVEQTPLLSIDHPVLPASFQNTRTLKRFRDKHLSDALLNGLKPHRSSLQLNEELNFAAERRDFVSPLLQTRHAAGVLSWRPTDRMHFYTSGNIGLGHDLLTGVRKDFGWNAGADFLLSQNLTAHVQGGWQQNFGFIPMTAVNGQLRWQATERLSFTTGIDYRQVQWNAFDNRTFSLKGSARYEVMDNVFVNGFGSYPLYSSTRSGLNMAVPMHGFGPQYGGSLELKVSERFGFAVGMEREYNIWTRRWETHYFAYPVFYGDKK

SEQ ID NO: 362 - protein, 329 aa, Porphyromonas gingivalis
ETNSWVSSDCNSTTMKTNRRYAFVLPLLLLTGLLAWGQDSSHGSNTAFATDSSSRELPTEQSAYRIHSAYMVGGGGSITRDTYLSPLRYGGWTLNLLGEKTFPLKASDSRWMIRTGHELDFALMDNPANNAHFYSLLYNGSAAALYRLGAKHLRAAWMDNLRLAFGPGLEIGLGGIYSTRNGNNPATLKLYTNAIAQASIGYYVPSETFPLYFRLLSQINLFGIAYGNGFGESYYENFLLNNGIAGSLHFTYPGKFTRFTTLITADIPIRNFCTLRVGYRYSHLGSSLNALDTRIHSHTAFIGFVTEFYRFRGRKAMNTGRRTSLYYHD

SEQ ID NO: 363 - protein, 319 aa, Porphyromonas gingivalis
FTSGTIFVRIAISGRVVCREVEDNGRREAVRHDGMVVTLLVIVGIVVVVRYSLRVHVHKTGTVVSAAIFGFILLGKTVPCDTRNFFSSESDEPESRVATEIAHLCEIGFQIHASSIHVAVRTDFGQAGIHCPMATDASATEFDRSAECAERTSAQIDTAIRSQSQIIRTHIDTCPKSSGTIGGSTHTSLHLKVFDGRGEVGHIHPKDGLRFGVVEGYSIGSYVDAIGIGATHAKAGISDTRTGIAGGYHGGSQHQQIGDVTTIIGLGKFGLANVGVSDRGFRRGASSYDLYGLELHIAKTIYLAVGDGCLCRQAERQDG

SEQ ID NO: 364 - protein, 614 aa, Porphyromonas gingivalis
PYNVQSISNKTIKKQMENLKNIQPREDFNWEEFEAGGVHAAVSRQEQEAAYDKTLNTIKEKEVVMGRVTAINKREVVINVGYKSEGVVPATEFRYNPELKVGDEVEVYIENQEDKKGQLVLSHRKGRAARSWERVNEALEKDEIVKGYVKCRTKGGMIVDVFGIEAFLPGSQIDVRPIRDYDAFVEKTMEFKIVKINQEYKNVVVSHKVLIEAELEQQKKEIIGKLEKGQVLEGIVKNITSYGVFIDLGGVDGLIHITDLSWGRVAHPEEIVQLDQKINVVILDFDEDRKRIALGLKQLMPHPWDALDSELKVGDKVKGKVVVMADYGAFVEIAQGVEGLIHVSEMSWTQHLRSAQDFLHVGDEVEAVILTLDREERKMSLGLKQLKPDPWADIETRFPVGSRHHARVRNFTNFGVFVEIEEGVDGLIHISDLSWTKKIKHPSEFTEVGADIEVQVIEIDKENRRLSLGHKQLEENPWDVFETVFTVGSIHEGTVIEVMDKGAVVSLPYGVEGFATPKHMVKEDGSQAVLEEKLPFKVIEFNKDAKRIIVSHSRVFEDEQKMAQREANAERKAEAKAAQKEAAAEAANPAQAVEKATLGDLGELAALKEKLSEN

SEQ ID NO: 365 - protein, 243 aa, Porphyromonas gingivalis
STIMKKAILSGAALLLGLCANAQNVQLHYDFGHSIYDELDGRPKLTTTVENFTPDKWGSTFFFIDMDYTGKGIQSAYWEISRELKFWQAPVSIHLEYNGGLSTSFTFGHDALIGATYTYNNPSFTRGFTITPMYKHLGAHDFHTYQITGTWYMHFLDGLLTFNGFLDLWGFPQENPIGGPVLKEGDKFVFLSEPQFWINLNRIKGIDKDFNLSIGTEMEISRNFARMDKFSCIPTLAVKWTFN

SEQ ID NO: 366 - protein, 235 aa, Porphyromonas gingivalis
MKTISKNHAARICAAIALFAVCNGRIAAQDFLYEIGGGFGAAQYFGDANRGLFGSSGVGLELVGRYNYNFRWAFSTMLDWRTLRGDTDKSGNVFPDFAQADFKVGLTQLHVRSEFNFLPYSDGYKYLGTARLSPYVAAGLSLGFASGAKGSAFAPGITAGMGVKYKLKPRINVGIEYSFTGLLTDALDALTDKSVWLEDPYKINDSWVKNKDATGALVLRITYDFGLRKTFCNKQ

SEQ ID NO: 367 - protein, 436 aa, Porphyromonas gingivalis
NIMYKDYKGLYASLRWYALIIGLLFAADGIQAQNNNFTESPYTRFGLGRLGERTTISGHSMGGLGVGLRQGTYVNAVNPASYSAVDSMTFIFDFGASTGITWYAENGKKDNRKMGNIEYFAMLFPISKSIAMSAGVLPYSASGYQFGSVDQVEGGSVQYTRKYLGTGNLNDLYVGIGATPFKNFSIGANASSLFGRFTHSRQVIFSTEAPYNPVHLSTLYLKAAKFDFGMQYHLLLKSDRSLVIGAVYSPRVKMHSELTQIKNQVQNGVVVESETQEYIKGMDYYTLPHTLGIGFSYEKKDKLLLGADVQYSKWKGEKFYKSDCKFQDRIRVSLGGEIIPDINAVGMWPKVRYRFGLHGENSYLKVPTKGGVYQGYHIVGAVFGIGIPLNDRRSFVNVSLEYDRLIPKEGMIKENALKLTFGLTFNESWFKKLKLN

SEQ ID NO: 368 - protein, 945 aa, Porphyromonas gingivalis
NTISENGNDSTYFSFQTFLMRSIYQLLLSILLASLGFVGLEAQQAGVAGRVLDEEGNPMIQANVQLVQSTGQVAVAAGATNEKGLFSLKTSQEGDYILRVSYVGYTTHDEKISLRNGQTITLKDISMNEDARLLQSVTVQAKAAEVVVRNDTLEFNAGSYTVAQGASIEELIKKLPGAEIGSDGKITINGKDISKILVDGKEFFSKDPQVAIKNLPADMVNKVQVLNKLSELSRMSGFDDGEEETVINLTVKPEKKKGLFGTLQAGYGTDQRYMAGGNVNRFDGNKQWTLIGSANNTNNMGFSEMDSEMGSMTFFSPQGGGRRGFGNSGGVTSSSMLGGNFSVEFSSALNTGGDARYGYNDKAIETTKRVENILAEGNTYMDENILERSFSHNGQARFRMQWKPSERTEVVFEPDLSISKIDGFFNDTYETKDATGISINKGSIHQTTQGNNFRLNGELDISHKLNDEGRTISASVSGGLTDEDGDGIYQAVLQSVETNQKQFNDNSNLQYRLRLSYVEPLGKNYFAQAILNRRFSRRNSDREVYRLGDDGQYSILDSQYGLSYSNEFTQYRIGLNLKKIAKTWDYTVGFNVDPNRTVSYRSVAGVEQDKLAFNRVNLSPMLRINYKPSRTTNLRVDYRGRTTQPSINQIAPVQDITNPLFVTEGNPGLKPSYSNNVMAMFSDFDAKSQRAFNIVFFGNYTFDDIVPNTHYDPSTGIRTTRYENASGTWQANLHGTLSLPLKNRAFSFRMSLFNRLAEGQSFINDDKNKALSFRTRERLTLTYRNNWIDTSIGGNIGFYMANNSLSGQKDSRTYDFGGNYQVALTLPYGFRIDSDVEYNTNSGYSGGFSLDEWLWNASLSYSFLRDKAGTLRVNGYDILGQRSSISRSASAINIEESMSNTIGRYVMVDFIYRFNAFSGGGSRSDHQRGNMNRPGPPFGGGRRPS

SEQ ID NO: 369 - protein, 412 aa, Porphyromonas gingivalis
GEYPANSNDKKEMVMKLIKRSLLLLGAVLLITLPAYSQNDDIFEDDIYTSRKEIRKQNQVKDWQNQEDGYGDDTEYTVASDRDIDAYNRRDGQSYDGKKLSKDKKRDSTRSSVPGRYSRRLARFYKPNTIVISGADNVYVTDDGEYFVYGDEYYDDASSVNIYINSPWCDPFPYTSWYPSFSGWYNYTWNYPWFYYGSHIGWGGYYPGYNWYWSYYYDPFYNPYGIGMGWGYPYGWGSYYGWGGYPGVIHHYHHYPKKTYSNGQHSGAYYSYGRPNRIKGGTSGAKLGTGRYDRIQNSSSQKNKFGLQSNKPNNNLQNVKSGRTGRANRDRNIETVTPNNGQKQNRPVFQQNQSGNDRPTGRNIRSERQGENNDRTFSTPSRSNSNGGFSTPSRSSSGSMSGGGGRSGRGRN

SEQ ID NO: 370 - protein, 601 aa, Porphyromonas gingivalis
SNSSSHKWLIYYHIEKTKSIMIRKLILLLALMPVASVAFAVPTDSTESKDNRILTSMQSSSLNRDDAPDKWQPMHANFSIQSDMLLSTAQKSKNTWFGNSYIMGIIKNNYLEFGARFEDLYKPLPGHEPEMGRGVPHMYVKGSYHWAELTMGDFYDQFGSGMVFRTYEERNLGIDNAVRGGRIVLTPFDGVRVKGIAGQQRNYFDRTGKVFNSGRGYLLGSDLELNVERWSSAMRDNDYHLAIGGSFVSKHEADEDIFVGVGEDRKRLNLPLNVPIMGLRTNFQKGGLALYAEYGYKYNDPSADNDYIYHDGQAALLSASYSKKGMSILLQAKRCENFAFRSKRSAQLTPLMINYMPAFTQAHTYTLAAIYPYATQPQGEWAFQGELRYNFARRTALGGRYGTGLRINVSHVRGLDKKMLKENPDELIGTDGYTVSFFGMGDLYYSDIDVEITKKVSPGFNFTLTYLNQIYNNKVLHGAAGEKPEKIYANIFVYDGKYKLSNKVALRTELQYLHTKQDQGDWIYGMAELSILPSLMLSLSEQYNIGETKKHYVMGSVTYTHGAHRVAFSAGKTRAGMNCSGGVCRVVPETQGFYLSYSTNL

SEQ ID NO: 371 - protein, 252 aa, Porphyromonas gingivalis
RGSSSGISARGRDMRSLFLSALRSSSLHGSERRSRISSSVVMSIRQKIRLFHLSVCAQTHDHLIEIHLVCIEFGAIDTDEFRLSSHAYTTSPTHTGAIHHNCIERSYGRYLVTFGQERNELHHHSRPDRNAEVYRFPFDNAFHSIRYEAFRPIRPIVCHDDHFIAIGSHLFFKDNQIFSSGSQYDNYTVACFVESLHDREQRSHTHTASGTNHCADLFDMRTLSQRTYHIRDIVADFEFGQFLGRFAHGLNH

SEQ ID NO: 372 - protein, 790 aa, Porphyromonas gingivalis
LLFSSPLPRMDRPKPSYIVRIAAILCLFVGRPLFAQSYVDYVDPLIGTLSSFELSAGNTYPVIGLPWGMNSWTPMTGVPGDGWQYTYSAHKIRGFKQTHQPSPWINDYGQFSLLPLTAPQKPSSNDSIALTKWCKQLFSDEQTSWFSHKAETATPYYYSVYLADYDTRVEMAPTERAAIFRIRYSGNTESGSGRWLRLDAFTGGSEISIVDPHTVVGISRKNSGGVPANFACYFILQSDTPMADVLLETDTGKSDEGTRAWAACRFDSQEVTVRVASSFISVEQAERNLAEVKGQSFDRIRLAGREAWNKVLGRIHVEGGTKDERTTFYSALYRCLLFPRRFYEEDASGNFVHYSPYNGEVLPGYLYTDTGFWDTFRALFPLLNLLYPDENIKIQEGLLNVYRESGFFPEWASPGHRDCMIGNNSASVLADAYLKGVRVEDTRTLMNGLLHATKAVHPKISSTGRKGWEWYNSLGYVPADAGIDESAARTLEYAYNDWCILRLGRTLGWDRAALDTLAHRSMNYRHLFDPETKLMRGRNQDGSFRTPFSPFKWGDVFTEGNAWHYTWSVFHDVQGLIDLMGGDRPFVSMLDSVFNTPPMFDESYYGFVIHEIREMQIADMGNYAHGNQPIQHMIYLYNHAGHPWKAQERLREVMGRLYRPTPDGYCGDEDNGQTSAWYVFSALGFYPVTPATDQYVLGSPIFSKVILSFPDGHKTVLHAPANSADTPYIRSISVEGKEWSCNYLTHEQLRSSASIQWMMDTKPNYNRGMKESDRPYSFSTEQQRRANHSN

SEQ ID NO: 373 - protein, 286 aa, Porphyromonas gingivalis
ICGSKMNLSGLQSFTMMKSMRSVLLLLFPLSLITALGCSNNKAAESKSVSFDSAYLERYIPLRADIDTPSLHVMISYVYPSGDDMLTEIFNGLLFGDSLMDSSSPENAMEGYAQMLGEDYRSNNAEANLQGLPSDLLDYIYKQENTIAYCDTGLISTRINTYTYEGGAHTENTVRFANILRTTGKVLEERDIFKIDYAERLSALIIGQLVHDFGKTTPAELDAIGFFNAEEIQPNGNFMIDDKGLTYCFNEYQIAAYARGAVYVRLGYDVLAPLLRDDSPLKRYLP

SEQ ID NO: 374 - protein, 378 aa, Porphyromonas gingivalis
GIISVLSHVVDRPQWGASPEAAGTHSVYSILHPSAGIIRIRSMGIISACRIAILAGKHPRSGLSRANVGILSYNPENTPEKKRKLQEKNVFLQIRLRQSFNNLIPSLPFRIDNTKKITEMKKTTLTGSICALLLFLGLSANAQSKLKIKSIEAATTFSSATAGNGFGGNIFGMDMSIRMRVHHSILPEGLDFSVGIHERRAHWEEAGSPKLMYTNVPSIIGIVEKVIVFEDAEDFFDKKALGRFLISLGISYTKHLGAYWGWTNDAHILFSPIPKSKVHYDTYTRAGSDLVLQSEDVATVSNGFSPGIGLKSSIWWKMPIKSKYDFRLGFSLGYEYLNLLYPYRNFKLDGNKPLSALSPRMNHIGHVGFNFTVGLWTN

SEQ ID NO: 375 - protein, 1269 aa, Porphyromonas gingivalis
VKCMGKYKRAKYRYWLFPFCSDYYTFEGVTFLCASDDMTTKKPQAILDLEKAYNIEIPDLSSQEGISWSVNRYFKQDSSGAVVELCLRECQIESMTWLIDFPALKKLDLSYNQISKLEGLERLTSLTKLRLRSNQIRKLEGLDSLTSLTKLSLSDNQISKLEGLERLTSLAELYLLDNQISKLEGLERLTSLATLELSGNQIRKLEGLERLTSLATLELSGNQIRKLEGLERLTSLTKLRLRSNQISKLEGLERLTSLATLELSGNQIRKLEGLERLTSLATLELSGNQISKLEGLERLSSLTKLRLRSNQISKLEGLERLTSLTKLSLSDNQISKLEGLERLTSLAELYLLDNQIRKLEGLERLTSLTKLRLRSNQISKLEGLDSLTSLTKLSLSDNQISKLEGLERLTSLAELYLLDNQIRKLEGLDGLASLTRLSLRRNQISKLEGLDRLKVLRKLDVSGNDIQSIDDIKLLAPILEQTLEKLRIHDNPFVASSGLILSPYDNHLPEIKALLEKEKEKQKKTSVEYHPFCKVMLLGNHSSGKTTFLSQYDTNYTYQKNTHVLSIHRSNNPNAIFYDFGGQDYYHGIYQAFFTTQSLYLLFWDAKKDRNFVSVDDKEYQTLNFNRPYWLGQIAYACNRCMSVGGNPDGKDTPQTTDDTIIIQTHADETGAKQQTLGCAAENGVLEEIYVSLEPKANSAVHALNYLNERVREVVASRSKSIQITEKDKGLYEALPTIAGDNKHIPISLEALAAQLNKGRAENDLYTIEYLQTELNQLSLRGEVLYYRENEKLNNYVWLDPAAFVQMIHGEILQKDNINRGTVPKDIFECKLHNLSSGSIFEEDGQNGNMILQLLLEELIVYEDKDCYVIPGYLPLHSDDEAYKWLTLGFERPNFVLKFERFIPFGLINQIIAYYGREEGALKRYWRDQVIFTAGREMDRQTLEQEEEKEGLPKTNAEDYQIWIKLDFTDLAISVFIKEQRKTSAKDMQRKEATILSDMLDMYWNNIPPREQIGDKDTEQTRSTIRETNRKKRPIQDLYLSCAQADKDLTESHYIHLGTLDDESKTTARIAAYPLKNGVIDKERVREVSTRPYKHLSVNKNLATAKQIFISYSKEDQTELETCLQFFKPLEKNGQIEIYYDKLTKFETPIHPEIRKRIVEADCIIALISQRYLATDYILDHELPVFREYNKTIVPILIKPCTFEDDEFLREKYFAQKAQIINLGKEGKTIKAYDSITASAHRDENWVAVVREFKEKILRITKQEVNTDE

SEQ ID NO: 376 - protein, 231 aa, Porphyromonas gingivalis
KFMMKKAFVFVLLVCLFSSFSSSAQTTTNSSRSYFTGRIEKVSLNLGVPPVSTEVWGMTHDANGLPFEIPISFSRFNSQGDIATTYYIANSEATLNEWCDYAHPGGIVRVEGRFWKMTYNIPTYNAVCTRITFENQEIEGTIVLIPKPKVSLPHVSESVPCIRTEAGREFILCEEDDTFVSHDGNEVTIGGKPFLLNTNVKIVGDVSQKYAVGVGEIRFLQICAQTVSQQK

SEQ ID NO: 377 - protein, 563 aa, Porphyromonas gingivalis
SLINNSRDWRAPVRLSLKKKTKTMKTKVLRKFVVAAFAVATLCPLAQAQTMGGDDVKVVQYNQEKLVQTRMSVADNGWIYVMTHSGYDTGNSNVKIFRSKDQGATYQKLRDWDPSDDYQFQDFDIVVTGKNESDIKIWSVELMNKPGGYKSRVAVFSRDANAQNAKLVYKEDFSNVQLYDVDIASNYRSPSSLNNGGNPFALAFAYTGFNNTHKISFVDYVFSLNGGQNFNKNLLFSQDGEKKIDKVDLSLGSTSESMGHNAWPLMGVVFEMNKQGGKSDIGFLSNFVDNDPEFQWSGPIKVSESDMSFSPKIQMLLDEDNNTINGESCHNFMITYSDYDSEYSDWDIRYVYPKKSFKYEKGKTPTMDDLVEAFLTASYQSETNSGLGYDKNANHYLITYAKKEENGTNTLKYRWANYDKIHNKDLWSDTFTYTSSANALYTPQVDINPTKGLVCWSWVEYLPGKRIVWSDTQWTHANGVEDIVMQEGSMKLYPNPAQEYAVISLPTAANCKAVVYDMQGRVVAEASFSGNEYRLNVQHLAKGTYILKVVSDTERFVEKLIVE

SEQ ID NO: 378 - protein, 786 aa, Porphyromonas gingivalis
IVYLCHCMNHRRSKTMLTIRNFLLFCCLSLIAFAADAQSSVSSGRRLTEYVNPFIGTANYGTTNPGAVLPNGLMSVTPFNVSGSTENRFDKDSRWWSAPYSADNSYCIGFSHVNLSGVGCPELSGILLMATSGTFDPDYCCYGSSLSREYARPGEYKAVLDKYGIDAAVTVTERTALTEFAFPEGEGHILLNLGQALSNESGASVRFLNDSTVVGSRLMGTFCYNPQAVFRQYFVLQVSRRPISAGYWKKQPPMTVEAQWDSTAGKYKQYDGYKREMSGDDIGVRFSFNCDQGEKIYVRSAVSFVSEANALYNLEAEQEEVFKSVGGNPAKAFSAIRSRAIERWEEALGTVEVEGGTPDEKTIFYTALYHLLIHPNILQDANGEYPMMGSGKTGNTAHDRYTVFSLWDTYRNVHPLLCLLYPEKQLDMVRTLIDMYRESGWLPRWELYGQETLTMEGDPSLIVINDTWQRGLRAFDTATAYEAMKKNASSAGATHPIRPDNDDYLTLGFVPLREQYDNSVSHALEYYLADWNLSRFAHALGHKEDAALFGKRSLGYRHYYNKEYGMLCPLLPDGSFLTPFDPKQGENFEPNPGFHEGSAYNYAFFVPHDIQGLARLMGGAKVFSERLQKVFDEGYYDPTNEPDIAYPYLFSYFPKEAWRTQKLTRELIDKHFCNAPNGLPGNDDAGTMSAWLVYSMLGFYPDCPGSPTYTLTSPVFPRVRIRLNPQYYPQGELIITTNTENQPTDSIYIHTVSLGNKTLPHGTRHISHADLVRCGHLRYELSNRPR

SEQ ID NO: 379 - protein, 814 aa, Porphyromonas gingivalis
PRFHPGGTHAQLCRNGRRNQKSNQSSCFGGGTAPRFFIMCKIRFSLLQALVVCLLFTSFSLQAQEEGIWNTLLAIHKTEKAVETPKKVFAVANGVLYSVGKEAPHEAKIFDRISGLSDTSVSSIAYSEQLKSLVIYYASGNIDILDEAGRVTNVPALKDNIDLIDKTLNRLLIVGNRAYLAGGFGLSVLDVAEARIPATYAKGTKVTDVAKLDNDRLLMLKEGQLFIGKETDNLQDPAAWTALSLNLPMGSVTGLGIVGEDICFLLADGRVYVAANQSFEPELLLSSSADSRLYVTDRGLFICAENRIYFIEKGRKTTQFPIADVLGVGAMNESNTAYIALGEEGLASLLLAEGSTAEAMPVAFDGPGDNDFYEMRFSHGRLYAASGLWGTNLMGHAGMVKLYDGNRWTNFDKKTVQEQLGGGFSFNDAIDIAVSNGDPDHFFVGTWGNGLFEFKDGKAIARYSGNETAIAECNPGDARVKAIAFDNKGNLWGTLGAVGKNIFMYDPQSSTWHSFSYPDVANLASFGNMIILPNGDKWVNILHRSGGSTRKGVLIFNDRGTPETTSDDSHLYVEQFVNRLGAAIGHKTIYAMAVDHNGSVWMGSDIGIFGVYNAAGVLSSTSTPIAVRPVGGEEPNLYYVLDKVTVTDIVVDKLNHKWVATQGTGLYLLSEDCSKILAQFTVENSPLLSNNILSLALNDDNGLLYIGTADGLMTFQTGTGSGSASELDGVYVYPNPLRPEYPDGVTIAGLQAGCSVKITDTTGRLLYQTESVTTEVKWNARGADGNRVASGVYAVAVYDPVSKKSKLIRFAVIR

SEQ ID NO: 380 - protein, 1162 aa, Porphyromonas gingivalis
AISQMKRILPIVAFLSLFLALALPAKAQRAMGKTADRSLMASGHWVKIRVDASGVYRLTDEQLRANGFSDPSKVGVFGYGGGVLPEDLSRITTDDLPPVPVLRQGNALYFYAVGPVTWFYNPAKTTMEHTVNTYSTHGYYFLSDAAGAPLQMSQYTGGGASAEALIDYYDELMLHEQELYSPKESGRDLYGESFSAVNTRTVKFPLRGNTRSSGELGTVFSYIAKARSAGGGREMSLSANGILIFSDPFSMTSNEVSNSYLAGKKRRLYHSTPMNSLVNELRLDANYSMTGDAVNLDFIEVATQNDLRYDGAPMHIRRFSNLPVLGGESCRFVISEVPESLVVLQANSSLTASLVPVKTVGDKTIEFVAPPKGQDRRTINTFYAVDLSQASAPEILGAVPNQNLHGEEIPDLIIVSTQALLLEADRLATYRREKNGLKVLVVLQEQVFNEFSGGTPDATAYRLFAKMFYDRWKANAPVGETFPMQMLLFGDGAHDNRKVSVAWQKPYLQQTEFLLTFQAVNSTNVNSYVTDDYFGLLDDQPASVNIGWRNYNMAVGRFPVRTPAEARIAVDKTIRYEEDRESGAWRIRACFAADNGDKHATETSRLIDTVKRYAPAIMPVRAFQDVYPHVIENGLHSIPGAKKKMLETLQSGIILLNYAGHGGPAGWSDEHLLTLNDIHKFNYKHMPIWITATCDFANYDSQTTSAGEEVFLHEKSGTPIMFSTTRVVYNTQNEKINGFMLRRMFEKAKDGRYRTMGEIIRSAKQGMLSTVFPDSINQLSFFLMGDPSVRMNLPTHKVQLTAINGQDPEGQYGTIMLKSLERVALKGKVTDEKGTFDETFSGKVFLTVFDGRKKMTALEEEGNDLSLVYYDYPNVMYAGIAEVKDGLFETSFIVPKDVNYSEHEGRINLYAYNESTKAEAMGVDFSIRVQPGIPDEVTEDNTPPEIISCFLNDSTFRSGDEVNPTPLFMAEVFDLNGINITGSGVGHDITLCIDGRADLTYNLNAYFTSSATDAGVGTILFMIPALAEGDHTARLTVWDIFNNAVHHDFSFRVVDGIAPDVADVILFPNPVRESATFRIFHNRPGSDLNVAVEIYDFTGRLVNSLPVKTYSSSYGEPIEIKWDLTSKYGVKIGNGFYLYRCVVNSPGGQTASMAKKMIVVGQ

SEQ ID NO: 381 - protein, 973 aa, Porphyromonas gingivalis
FYTGIDLHIESQMKKLFPLLLLILSILVGCGKKEKHSVTEIAREKKRITALLYEKELPTDSVKQLYENSVQNKNLVGQMLFAIEVGKRMRNMSQYTDAMLYHQKGLNAALNLRDTIVAAQAWNHLGTDSRRIGALAEASDYHYKALSLIESFSGNQNRPAIKARSAALNGIGNINLELGYHDEAEKNFLKALQGEKELDSPLGQAINYANLGRIYRQRKEYDKARTYFLLSLEQNNMAENLMGIGLCSINLGEVDEEKGDYQKALQEYATAYKLMEQLSDRWHWLNSCIPMARINLKQGNERLYQHFISLAEGTAKEINSTSHLIEIYNLQYENLERKKEYKQALEAFCLSKTLSDSMSIAHKVSSIQETRFNYERNKSQKELEEIQQVSKAKQEKSKFILLSTLFALFISILLISVLTYAYRQGKKHNKLIKETDKLRSGFFTGITHEFRTPITVIQGLNEKMSSSPDLQASDRTELHKIIDRQSSHMLNLVNQLLDICKIRSGVSTPEWRNGDIVSFVQILIDSFAPYAQAQDITLELQPESKPIVVDFVPSYLQKIISNLLSNAIKYSLAGGRVVISLAKTKNEKNLIIRVADNGIGIDKTDQAHIFDIFYRGQSATEKHGSGVGLSFTNILVENLRGTIKVESQPGKGSAFTISIPTQNQSSSAEILPWLPSSDDIVMPVHIAPDDSPTSPMVAALNHRFEDERPTILLVEDNKDINLLVKLLLCDRYNVLSAANGKEGIALATEHIPDIIITDIMMPIMDGIEMTIRMKQSPLLCHIPIVALTAKSTEQDRLEGIKSGVVSYLCKPFSPEELLMRIEQLLKDRELLKKFYMQKLMLDRKPEEEPQPIDDSSMQFLLAAKDAVSGGIKQNPDFSAQDLAEKMCMSPSQLNRKLTSVVGCSTIGYIQQIKIKLACKLLADESKNISDISIEAGFSDPAYFSRTFKRYMNCSPSQYRQKLLAMPGSDKETV

SEQ ID NO: 382 - protein, 563 aa, Porphyromonas gingivalis
HHKTYQTMKKLLQAKALILALGLFQLPAIAQTQMQADRTNGQFATEEMQRAFQETNPPAGPVRAIAEYERSAAVLVRYPFGIPMELIKELAKNDKVITIVASESQKNTVITQYTQSGVNLSNCDFIIAKTDSYWTRDYTGWFAMYDTNKVGLVDFIYNRPRPNDDEFPKYEAQYLGIEMFGMKLKQTGGNYMTDGYGSAVQSHIAYTENSSLSQAQVNQKMKDYLGITHHDVVQDPNGEYINHVDCWGKYLAPNKILIRKVPDNHPQHQALEDMAAYFAAQTCAWGTKYEVYRALATNEQPYTNSLILNNRVFVPVNGPASVDNDALNVYKTAMPGYEIIGVKGASGTPWLGTDALHCRTHEVADKGYLYIKHYPILGEQAGPDYKIEADVVSCANATISPVQCYYRINGSGSFKAADMTMESTGHYTYSFTGLNKNDKVEYYISAADNSGRKETYPFIGEPDPFKFTCMNETNTCTVTGAAKALRAWFNAGRSELAVSVSLNIAGTYRIKLYNTAGEEVAAMTKELVAGTSVFSMDVYSQAPGTYVLVVEGNGIRETMKILK

SEQ ID NO: 383 - protein, 437 aa, Porphyromonas gingivalis
TTNRKPNTNMKLSSKKILAIIALLTMGHAVQAQFVPAPTTGIRMSVTTTKAVGEKIELLVHSIEKKGIWIDLNGDATYQQGEEITVFDEAYHEYTIGTQTLTIYGNTTRLGCRSTGATAVDVTKNPNLTYLACPKNNLKSLDLTQNPKLLRVWCDSNEIESLDLSGNPALIILGCDRNKLTELKTDNNPKLASLWCSDNNLTELELSANPRLNDLWCFGNRITKLDLSANPLLVTLWCSDNELSTLDLSKNSDVAYLWCSSNKLTSLNLSGVKGLSVLVCHSNQIAGEEMTKVVNALPTLSPGAGAQSKFVVVDLKDTDEKNICTVKDVEKAKSKNWRVFDFNGDSDNMLPYEGSPTSNLAVDAPTVRIYPNPVGRYALVEIPESLLGQEAALYDMNGVKVYSFAVESLRQNIDLTHLPDGTYFFRLDNYTTKLIKQ

SEQ ID NO: 384 - protein, 318 aa, Porphyromonas gingivalis
NHLKTNIKMRKTIIFCLLLALFGCSWAQERVDEKVFSAGTSIFRGILEKVKAPLMYGDREVWGMARASEDFFFILPVTDDLTPVLFYNRLTNEPCFVSDQGITEYFKFAQEGDYIEVEGSSVFMANLLYYRFFPTRITSYNAPIEGVVSKTGNPAFTIPMLPGVSDCIEISNNRKVFLTNQLGVVNITDGMEPPIIAGVSASYGSSVRVYGHVSQRWDIIGHCYLDIYPTNCYPLSTKPVAGDDEVFVKQQGRQIEIDSNSPIVQVVVYDLEGKSVFRKRMTENAYTLSFRAPMLGFMTIMIETQNSIINKKLNVTQL

SEQ ID NO: 385 - protein, 461 aa, Porphyromonas gingivalis
RRAVKIRSPPHIHSLFVRKCLFSDFKYLYLSRKITQERLGRLSIRLKSYNPIIIIEMKKTTIISLIVFGAFFAAVGQTKDNSSYKPFSKEDIAGGVYSLPTQNRAQKDNAEWLLTATVSTNQSADTHFIFDENNRYIARDIKANGVRKSTDSIYYDANGRISHVDLYISFSGGEPALDTRFKYTYDDEGKMTVREVFMLVMDPNTPISRLEYHYDAQGRLTHWISFAFGAESQKNTYHYNEKGLLVSEVLSNAMGTTYSDTGKTEYSYDDADNMVKAEYFVVQQGKAWQVLKREEYTYEDNICIQYLAINGTDTKVYKRDIESDKSISANVIDIPSMPEQTWPNMYGFNAKRLKETYSSYEGDVATPIFDYIYTYKALTSMATPSTEAQVAVYLNPSTDRLVILANGITHLSMYDLQGKLIRDCALSGDKVEMGVGSLTKGTYLLKVNTDQGAFVRKVVIR

SEQ ID NO: 386 - protein, 451 aa, Porphyromonas gingivalis
MAKVIKTKKGLALNLKGKPLPEMLAEPAQSPTYAVVPDDFEGVIPKVTARPGDKVRAGSALMHHKAYPEMKFTSPVSGEVIAVNRGAKRKVLSIEVKPDGLNEYESFPVGDPSALSAEQIKELLLSSGMWGFIKQRPYDIVATPDIAPRDIYITANFTAPLAPDFDFIVRGEERALQTAIDALAKLTTGKVYVGLKPGSSLGLHNAEIVEVHGPHPAGNVGVLINHTKPINRGETVWTLKATDLIVIGRFLLTGKADFTRMIAMTGSDAAAHGYVRIMPGCNVFASFPGRLTIKESHERVIDGNVLTGKKLCEKEPFLSARCDQITVIPEGDDVDELFGWAAPRLDQYSMSRAYFSWLQGKNKEYVLDARIKGGERAMIMSNEYDRVFPMDIYPEYLLKAIIAFDIDKMEDLGIYEVAPEDFATCEFVDTSKIELQRIVREGLDMLYKEMN

SEQ ID NO: 387 - protein, 195 aa, Porphyromonas gingivalis
MDKVSYALGLSIGNNFKSSGIDSVVMDDFMQGLSDVLEEKAPQLSYDEAKREIEAYFMDLQQKAVKLNKEAGEEFLKINAHKEGVTTLPSGLQYEVIKMGEGPKPTLSDTVTCHYHGTLINGIVFDSSMDRGEPASFPLRGVIAGWTEILQLMPVGSKWKVTIPSDLAYGDRGAGEHIKPGSTLIFIIELLSINK

SEQ ID NO: 388 - protein, 273 aa, Porphyromonas gingivalis
MKKALLIGAALLGAVSFASAQSLSTIKVQNNSVQQPREEATIQVCGELAEQVDCIGTGNSAIIAAAAKFESDDLESYVGWEIMSVDFFPGYKACKYTSAVWADDMTILGQSEDSDPEMQTINNLALKTSVKIEAGKNYIVGYIANTAGGHPIGCDQGPAVDGYGDLVSISEDGGATFPPFESLHQAVPTLNYNIYVVVHLKKGEGVEAVLTNDKANAYVQNGVIYVAGANGRQVSLFDMNGKVVYTGVSETIAAPQKGMYILRVGAKSIKLAI

SEQ ID NO: 389 - protein, 554 aa, Porphyromonas gingivalis
MPRIMKLKIALRLLLATFAIVLFSPLAKAQMDIGGDDVLIETMSTLSGYSEDFYYKMAVADNGWIYVMLDFSRIYFDDVRLYRSKDGGATYQKLGSLGSLVPYDFDVSHCDFIVTGKDEDDINVWTVMTAFEYVGGTIGNGVLLMHRHDADINNTECVYKKDFPNNRLMGVAIASNYRAPSPYGLGGDPFALAVAVSGSGSDHSFLDYIFSLDGGVHFEQKRIYTRPQKLTINRVDLSLGSTSPSLGFNTWPLMGVVFEMNKNLDGFDIGFISNFVDYDPRYAWSEPIIIEEDCGWTDFNPLGALSIEIQMMLDDNSDNTVGGERSHNFLITYPGHYVYPKQSFNYSPGHTPTKKDLVFKHCIGIPALAYDKEGDRYLTTFQDHNLMRYRWIKYDDINSFYGWSWPYVYAKEAKDKKRRRPQVALNPTNGKACWVWHTRKSPYDETKPHPTPVIIKHFLWSDTEWVHALDVGDVLQKEGSMKLYPNPAKEYVLINLPKEGGHEAVVYDMQGRIVEKVSFSGKEYKLNVQYLSKGTYMLKVVADTEYFVEKIIVE

SEQ ID NO: 390 - protein, 550 aa, Porphyromonas gingivalis
MKLKIALRLLLATFAIVLFSPLAKAQMDIGGDDVLIETMSTLSGYSEDFYYKMAVADNGWIYVMLDFSRIYFDDVRLYRSKDGGATYQKLGSLGSLVPYDFDVSHCDFIVTGKDEDDINVWTVMTAFEYVGGTIGNGVLLMHRHDADINNTECVYKKDFPNNRLMGVAIASNYRAPSPYGLGGDPFALAVAVSGSGSDHSFLDYIFSLDGGVHFEQKRIYTRPQKLTINRVDLSLGSTSPSLGFNTWPLMGVVFEMNKNLDGFDIGFISNFVDYDPRYAWSEPIIIEEDCGWTDFNPLGALSIEIQMMLDDNSDNTVGGERSHNFLITYPGHYVYPKQSFNYSPGHTPTKKDLVFKHCIGIPALAYDKEGDRYLTTFQDHNLMRYRWIKYDDINSFYGWSWPYVYAKEAKDKKRRRPQVALNPTNGKACWVWHTRKSPYDETKPHPTPVIIKHFLWSDTEWVHALDVGDVLQKEGSMKLYPNPAKEYVLINLPKEGGHEAVVYDMQGRIVEKVSFSGKEYKLNVQYLSKGTYMLKVVADTEYFVEKIIVE

SEQ ID NO: 391 - protein, 390 aa, Porphyromonas gingivalis
MKRLLPFLLLAGLVAVGNVSAQSPRIPQVDVHTRIARNARYRLDKISVPDSRQIFDYFYKEETIPTKIQTTTGGAITSIDSLFYEDDRLVQVRYFDNNLELKQAEKYVYDGSKLVLREIRKSPTDETPIKKVSYHYLCGSDMPFEITTEMSDGYFESHTLNYLNGKIARIDIMTQQNPSAELIETGRMVYEFDANNDAVLLRDSVFLPLQNKWVEMFTHRYTYDNKHNCIRWEQDEFGTLTLANNFEYDTTIPLSSVLFPTHEEFFRPLLPNFMKHMRTKQTYFNNSGEGLSEVCDYNYFYTDMQGNALTDVAVNESIKIYPRPATDFLRIEGSQLLRLSLFDMNGKLIRATELTGDLAIIGVASLPRGTYIAEITAANSKTIRAKVSLR

SEQ ID NO: 392 - protein, 411 aa, Porphyromonas gingivalis
MRQHLSLFPFILFLLLAFSYVGCRTVRQTPKQSERYVVVLSLDGFRPDYTDRARTPALDRMAQEGLSGSLQPCFPSLTFPNHYSMATGLYPDHHGIVANEFVDSLLGIFRISDRKAVETPGFWGGEPVWNTAARQGIRTGVYFWVGSETAVNGNRPWRWKKFSSTVPFRDRADSVIAWLGLPEKERPRLLMWYIEEPDMIGHSQTPESPLTLAMVERLDSVVGYFRKRLDSLPIAAQTDFIIVSDHGMATYENEKCVNLSHYLPADSFLYMATGAFTHLYPKPSYTERAYEILRAIPHISVYRKGEVPKRLRCGTNPRLGELVVIPDIGSTVFFAINEDVRPGAAHGYDNQAPEMRALLRAVGPDFRPGSRVENLPNITIYPLICRLLGIEPAPNDADETLLNGLIRDKRP

SEQ ID NO: 393 - protein, 246 aa, Porphyromonas gingivalis
MKVGLFIPCYVNAVYPEVGIATYKLLKSLDIDVDYPMDQTCCGQPMANAGFEQKAQKLALRFEELFESYDVVVGPSASCVAFVKENYDHILRPTGHVCKSAAKVRDICEFLHDDLKITSLPSRFAHKVSLHNSCHGVRELHLSTPSEVHRPYHNKVRRLLEMVQGIEVFEPKRIDECCGFGGMYSVEEPEVSTCMGHDKVLDHISTGAEYITGPDSSCLMHMQGVIDREKLPIKTIHAVEILAANL

SEQ ID NO: 394 - protein, 246 aa, Porphyromonas gingivalis
MDIVSMADKALVVEMRDVTLCQEENVIFQNLNLTLSAGDFVYLIGSVGSGKSTLLKALYAEVPISAGYARVIDYDLAKLKRKQLPYLRRNLGIVFQDFQLLNGRTVAENLDFVLRATDWKNRADREQRIEEVLTRVGMSRKAYKRPHELSGGEQQRVGIARALLAKPALILADEPTGNLDSVTGLQIASLLYEISKQGTAVLMSTHNSSLLSHLPARTLAVRKNGDASSLVELSADAVSRKNTEID

SEQ ID NO: 395 - protein, 241 aa, Porphyromonas gingivalis
MADKALVVEMRDVTLCQEENVIFQNLNLTLSAGDFVYLIGSVGSGKSTLLKALYAEVPISAGYARVIDYDLAKLKRKQLPYLRRNLGIVFQDFQLLNGRTVAENLDFVLRATDWKNRADREQRIEEVLTRVGMSRKAYKRPHELSGGEQQRVGIARALLAKPALILADEPTGNLDSVTGLQIASLLYEISKQGTAVLMSTHNSSLLSHLPARTLAVRKNGDASSLVELSADAVSRKNTEID

SEQ ID NO: 396 - protein, 232 aa, Porphyromonas gingivalis
MRDVTLCQEENVIFQNLNLTLSAGDFVYLIGSVGSGKSTLLKALYAEVPISAGYARVIDYDLAKLKRKQLPYLRRNLGIVFQDFQLLNGRTVAENLDFVLRATDWKNRADREQRIEEVLTRVGMSRKAYKRPHELSGGEQQRVGIARALLAKPALILADEPTGNLDSVTGLQIASLLYEISKQGTAVLMSTHNSSLLSHLPARTLAVRKNGDASSLVELSADAVSRKNTEID

SEQ ID NO: 397 - protein, 219 aa, Porphyromonas gingivalis
MIEISNLTKVFRTEEIETVALDGVSLKVDKGEFIAIMGPSGCGKSTLLNILGLLDNPTSGIYKLDGAEVGNLREKDRTAVRKGNIGFVFQSFNLIEEMTVSENVELPLVYLGVKASERKERVEEALRKMSISHRAGHFPNQLSGGQQQRVAIARAVVANPKLILADEPTGNLDSKNGADVMELLRGLNREGATIVMVTHSEHDARSAGRIINLFDGKIR

SEQ ID NO: 398 - protein, 595 aa, Porphyromonas gingivalis
  MOD_RES (58)..(58): Xaa can be any naturally occurring amino acid
MKEFFKMFFASILGVITAGIILFCIFLFIFFGIVAGIASKATGGTIPKIEANSILHIXNSSFPEIVSANPWSMLTGKDESVSLSQAVEAIGQAKNNPNITGIFLDLDNLSVGMASAEELRRALQDFKMSGKFVVSYADRYTQKGYYLSSIADKLYLNPKGMLGLIGIATQTMFYKDALDKFGVKMEIFKVGTYKAAVEPFMLNRMSDANREQITTYINGLWDKITSDIAESRKTAMDSVKMFADKGEMFGLAEKAVEMKLVDELAYRTDVEKELKKMSQRGEKDELRFVSLSQVLANGPMNKTKGSRIAVLFAEGEITEEIIKKPFDTDGSSITQELAKEIKAAADDDDIKAVVLRVNSPGGSAFTSEQIWKQVADLKAKKPIVVSMGDVAASGGYYIACAANSIVAEHTTLTGSIGIFGMFPNFAGVAKKIGVNMDVVQTSKYADLGNTFAPMTVEDRALIQRYIEQGYDLFLTRVSEGRNRTKAQIDSIAQGRVWLGDKALALGLVDELGGLDTAIKRAAKLAQLGGNYSIEYGKTKRNFFEELLSSSAADMKSAILSTILSDPEIEVLRELRSMPPRPSGIQARLPYYFMPY

SEQ ID NO: 399 - protein, 589 aa, Porphyromonas gingivalis
  MOD_RES (52)..(52): Xaa can be any naturally occurring amino acid
MFFASILGVITAGIILFCIFLFIFFGIVAGIASKATGGTIPKIEANSILHIXNSSFPEIVSANPWSMLTGKDESVSLSQAVEAIGQAKNNPNITGIFLDLDNLSVGMASAEELRRALQDFKMSGKFVVSYADRYTQKGYYLSSIADKLYLNPKGMLGLIGIATQTMFYKDALDKFGVKMEIFKVGTYKAAVEPFMLNRMSDANREQITTYINGLWDKITSDIAESRKTAMDSVKMFADKGEMFGLAEKAVEMKLVDELAYRTDVEKELKKMSQRGEKDELRFVSLSQVLANGPMNKTKGSRIAVLFAEGEITEEIIKKPFDTDGSSITQELAKEIKAAADDDDIKAVVLRVNSPGGSAFTSEQIWKQVADLKAKKPIVVSMGDVAASGGYYIACAANSIVAEHTTLTGSIGIFGMFPNFAGVAKKIGVNMDVVQTSKYADLGNTFAPMTVEDRALIQRYIEQGYDLFLTRVSEGRNRTKAQIDSIAQGRVWLGDKALALGLVDELGGLDTAIKRAAKLAQLGGNYSIEYGKTKRNFFEELLSSSAADMKSAILSTILSDPEIEVLRELRSMPPRPSGIQARLPYYFMPY

SEQ ID NO: 400 - protein, 313 aa, Porphyromonas gingivalis
MRANIWQILSVSVLFFFGTAIGQAQSRNRTYEAYVKQYADEAIRQMSRYNIPASITIAQALVETGAGASTLASVHNNHFGIKCHKSWTGKRTYRTDDAPNECFRSYSAARESYEDHSRFLLQPRYRPLFKLDREDYRGWATGLQRCGYATNRGYANLLIKMVELYELYALDREKYPSWFHKSYPGSNKKSHQTTKQKQSGLKHEAYFSYGLLYIIAKQGDTFDSLAEEFDMRASKLAKYNDAPVDFPIEKGDVIYLEKKHACSISKHTQHVVRVGDSMHSISQRYGIRMKNLYKLNDKDGEYIPQEGDILRLR

SEQ ID NO: 401 - protein, 523 aa, Porphyromonas gingivalis
MDGRRYSDGLHQAIEAKEHVKVEAATQTFATITLQNYFRMYHKLAGMTGTAETEAGELWDIYKLDVVVIPTNKPIARKDMNDRIYKTAREKYAAVIEEIVRLVEEGRPVLVGTTSVEISELLSRMLRLRGIQHNVLNAKLHQKEAEIVAQAGQKGTVTIATNMAGRGTDIKLSAEVKKAGGLAIIGTERHESRRVDRQLRGRSGRQGDPGSSIFYVSLEDHLMRLFATEKIASLMDRLGFKEGEVLENNMLSKSVERAQKKVEENNFGIRKHLLEYDDVMNSQREVIYTRRRHALMGERIGMDVLNTIYDVCKALIDNYAEANDFEGFKEDLMRALAIESPITQEIFRGKKAEELTDMLFDEAYKSFQRKMDLIAEVAHPVVHQVFETQAAVYERILIPITDGKRVYNIGCNLREADETQGKSIIKEFEKAIVLHTIDESWKEHLREMDELRNSVQNASYENKDPLLIYKLESYELFRKMVEAMNRKTVAILMRARIPVPEAPSQEELEHRRQIEIRHATQQR

SEQ ID NO: 402 - protein, 375 aa, Porphyromonas gingivalis
MNFLKKEPFKIFSMIYLLLDTITNRAGTERAVINLANNLHANGHRVSLVSVCTKEGEPSFQVEKGIEVHHLGIRLYGNALARKTVYFKAYRRIKALYKKREPVLLIGTNIFINTILSQISNRGRIFTIGCEHISYDIARPITKRIRGFLYSGLDAVVALTKRDQQSFEAILRGRSKAYVIPNQVSFTTVQRDATTHKQMLAIGRLTYQKGFEFMIEDASRVLRERPDWKLIIVGDGENESMLRKEIASRNMESQIEIHPSTPEIRKYYESSAIYLMTSRFEGLPMVLLEAEAYALPIISYDCPTGPRELIENGRNGFLVPMEAHEDFADKLRLLMDDETLRKKMGQESELMVKSYSPANIYECWKKLFVEIGYMN

SEQ ID NO: 403 - protein, 362 aa, Porphyromonas gingivalis
MIYLLLDTITNRAGTERAVINLANNLHANGHRVSLVSVCTKEGEPSFQVEKGIEVHHLGIRLYGNALARKTVYFKAYRRIKALYKKREPVLLIGTNIFINTILSQISNRGRIFTIGCEHISYDIARPITKRIRGFLYSGLDAVVALTKRDQQSFEAILRGRSKAYVIPNQVSFTTVQRDATTHKQMLAIGRLTYQKGFEFMIEDASRVLRERPDWKLIIVGDGENESMLRKEIASRNMESQIEIHPSTPEIRKYYESSAIYLMTSRFEGLPMVLLEAEAYALPIISYDCPTGPRELIENGRNGFLVPMEAHEDFADKLRLLMDDETLRKKMGQESELMVKSYSPANIYECWKKLFVEIGYMN

SEQ ID NO: 404 - protein, 640 aa, Porphyromonas gingivalis
MGKIIGIDLGTTNSCVSVLEGNEPIVITNSEGKRTTPSVVAFVDGGERKVGDPAKRQAITNPTKTIYSIKRFMGETYDQVSREVERVPFKVVRGDNNTPRVDIDGRLYTPQEISAMILQKMKKTAEDYLGQEVTEAVITVPAYFNDAQRQATKEAGEIAGLKVRRIVNEPTAASLAYGLDKSNKDMKIAVFDLGGGTFDISILELGDGVFEVKSTNGDTHLGGDDFDHVIIDWLAEEFKSQEGVDLRQDPMAMQRLKEAAEKAKIELSSTSSTEINLPYIMPVNGIPKHLVMTLTRAKFEQLADRLIQACVAPCETALKDAGMSRGDIDEVILVGGSTRIPAIQEIVEKIFGKAPSKGVNPDEVVAVGAAIQGGVLTGEVKDVLLLDVTPLSLGIETMGGVMTRLIDANTTIPTKKSEIFTTAVDNQPSVEIHVLQGERSLAKDNKSIGRFNLDGIAPAPRQTPQIEVTFDIDANGILNVTAHDKATGKKQNIRIEASSGLSDDEIKRMKEEAQANAEADKKEKERIDKINQADSMIFQTEKQLKELGDKFPADKKAPIDTALDKLKEAHKAQDVAAIDTAMAELQTALSAAGEELYKNAGAAQGGAQPGPDFGGAQGPSAGDQPSDDKNVTDVDFEEVK

SEQ ID NO: 405 - protein, 449 aa, Porphyromonas gingivalis
MRYDLAIIGGGPAGYTAAERAAKGGLKTLLIEKNALGGVCLNEGCIPTKTLLYSAKVLHQIATASKYAVSGTADGLDLGKVIARKGKIIRKLTAGIRSRLTEAGVEMVTAEATVTGCDADGIIGITAGEAQYKAANLLLCTGSETFIPPIPGVEQTEYWTNREALQNKEIPTSLVIIGGGVIGMEFASFFNGIGTQVHVVEMLPEILNGIDPEHAAMLRAHYEKEGIKFYLGHKVTSVRNGAVTVEYEGESKEIEGERILMSVGRRPVLQGFESLGLVLAGKGVKTNERMQTSLPNVYAAGDITGFSLLAHTAVREAEVAVDQILGKTDETMSYRAVPGVVYTNPEVAGVGETEESLRKAGRAYTVRRLPMAFSGRFVAENEQGNGECKLLLDEENRLIGAHLIGNPAGELIVTAAMAIETGMTDRQIERIIFPHPTVGEILKETLAGG

SEQ ID NO: 406 - protein, 941 aa, Porphyromonas gingivalis
MELKRFLSLGLLLVGFIPMKLSAQQAQPLPTDPAVRVGKLDNGLTYFIRHNENPKDRADFFIAQKVGSILEEDSQSGLAHFLEHMAFNGTKNFPGKNLINYLETIGVRFGQNLNASTGFDKTEYTIMDVPTTRQGIIDSCLLILHDWSNNITLDGHEIDEERGVIQEEWRARRDANLRMFEAILAKAMPGNKYAERMPIGLMDVVLNFKHDELRNYYKKWYRPDLQGLVIVGDIDVDYVENKIKELFKDVPAPVNPAERIYTPVEDNDEPIVAIATDAEATTTQLSISFKSDPTPQEVRGSIFGLVEDYMKQVITTAVNERLSEITHKPNAPFLSAGAFFSNFMYITQTKDAFNFVATVREGEAEKAMNALVAEIESLRQFGITKGEYDRARTNVLKRYENQYNERDKRKNNAYANEYSTYFTDGGYIPGIEVEYQTVNAFAPQVPLEAFNQAIAQMIDPVKNAVVTLTGPSKAEAKIPSEADFLAAFKAARQQKVEAKKDEVSDQKLMEKAPKAGKIVSEKKDQKFGTTELTLSNGIKVYLKKTDFKSNEILMSALSPGGILSGKHAPNQSVMNSFMNVGGLGNFDAIQLDKVLTGRSASVSPSLSLLSEGLSGKTTVEDMETFFQLIYLQMTANRKDPEAFKATQEKLYNNLKNQEANPMAALMDSIRHTMYGDNPMMKPMKAADVEKVNYDQVMAFYNERFADAGDFMFFFIGNLDEAKMKPLIETYLASLPNLKRGDKMNKAQVPAARSGKIDCKFEKEMDTPSTTIFDVVSGNVEYTLKNSLLLEVFSAVMDQVYTATVREKEGGAYSVAAFGGLEQYPQPKALMQIYFPTDPARAEEMNAIVFAELEKLAKEGPNVEYFKKTIENLNKQHKESLRENRFWLEAMKASFFEGNDFITDYESVLNGLTPAELQKFAADLLKQQNRVVVMMAPVAKAQ

SEQ ID NO: 407 - protein, 684 aa, Porphyromonas gingivalis
MSKKGTIGVTSDNIFPVIKKFLYSDHEIFLREIVSNAVDATQKLKTLTSVGEFKGETGDLRVTVSVDEVARTITVSDRGVGMTEEEVEKYINQIAFSSAEEFLEKYKDDKAAIIGHFGLGFYSAFMVSERVDVITRSFREDATAVKWSCDGSPEYTLEPADKADRGTDIVMHIDEENSEFLKKEKIEGLLGKYCKFLTVPIIFGKKQEWKDGKMQDTDEDNQINDTHPAWTKKPADLKDEDYKEFYRSLYPMSEEPLFWIHLNVDYPFNLTGILYFPKIKNNLDLQRNKIQLYCNQVYVTDEVQGIVPDFLTLLHGVIDSPDIPLNVSRSYLQSDANVKKISSHITKKVADRLEEIFKNDRPTFEEKWDSLKLFVEYGMLTDEKFYERAAKFFLFTDMDGHKYTFDEYRTLVEGVQTDKDGQVVYLYATDKHGQYSHVKRASDKGYSVMLLDGQLDPHIVSLLEQKLEKTHFVRVDSDTINNLIRKEERAEVKLSDTERATLVKLFEARLPRDEKKHFNVAFESLGAEGEAILITQAEFMRRMRDMAQLQPGMSFYGELPDSYNLVLNTDHPLIDRVLSGEKESVEPSLTELRAKIAELKAEEAKLLDEEKGKKPEEIPVATKEAKENNAVEQAKTEGSINDQLTKYAQDNELIGQLIDLALLGSGLLTGEALAEFIRRSQRLL

SEQ ID NO: 408 - protein, 464 aa, Porphyromonas gingivalis
MEKLIDILVVDDDVAVCAALRLVLKRAGYNPVIANSPDEALSIMRNPDGGCKPAVILMDMNFSLSTSGREGLELLEKMQIFTSCPVILMTAWASIPLAVEGMRLGAFDFIGKPWDNDRLLRTIDTALHLAAPSAVANPSEQSDRDTARQPKATVQENDPCAHIIGRSDAICKIKERIRRIAPTHASVLITGESGTGKELIAEALHRGSKRASAPFVKVNLGGIPESLFESELFGHKKGAFTNAFSDRKGRFELADGGTIFLDEIGELPVGNQVKLLRVLQEQTFEPLGESVSHRVDIRVVSATNASLERMVAEGRFREDLYYRINLIHLHLPPLRERQEDIQLLVEAFSEAFAQSNGLPHAVWSAEAMRRICAMPLPGNVRELKNVVERTLLLSGSREISARDVADFGSQVTAADHSDERALTDMEEAAIRETLTKYNGNVSRAARALGLSRAALYRRMEKYGL

SEQ ID NO: 409 - protein, 250 aa, Porphyromonas gingivalis
MLKIKNLHATVQGKEILKGINLEINAGEIHAIMGPNGSGKSTLSSVLVGHPSFEVTEGEVTFNGIDLLELEPEERAHLGLFLSFQYPVEIPGVSMVNFMRAAVNEHRKAIGAEPVSASDFLKMMREKRAIVELDNKLASRSVNEGFSGGEKKRNEIFQMAMLEPKLAILDETDSGLDIDALRIVAGGVNRLRSPENAAIVITHYQRLLEYIKPDFVHVLYKGRIVKSGGAELALTLEEKGYDWIKEEIGE

SEQ ID NO: 410 - protein, 461 aa, Porphyromonas gingivalis
MAKEKTIYVCRSCGTKYAKWQGNCNACGEWNCIDEEKVPAPASGKHAAKSFMPREQDNRPRLLQDVESGDEERIRLGDEEFDRVLGGGIVKGAFVLLGGEPGIGKSTLILQTVLRLPQLRTLYVSGEESARQLKMRAERLGQAMNGCYVYCETNIERILSRAEELTPDLLVIDSIQTVYTEEMESSAGSVGQIRECAALLLKYCKTTGIPVIVIGHITKEGSIAGPKVLEHIVDTVLLFDGDKHHLYRILRGQKNRYGSTSELGIYEMRQDGLRGVENPSEHLITRNREDLSGIAIAVAMEGIRPILIEAQALVSSAIYANPQRSATGFDIRRMNMLLAVLEKRAGFKLIQKDVFLNIAGGIKIADPATDLAVISAVLASSLDIVIPPAVCMTGEVGLSGEIRPVSRIEQRITEARRIGFKEILVPADNFRQEDAGRFGIRLVPVRKVEEAFRHLFSKGRE

SEQ ID NO: 411 - protein, 271 aa, Porphyromonas gingivalis
MNSRHLTITIIAGLSLFVLTLGGCSVAQQDTQWTLGGKLFTSAWIQRSAEYQALCIQAYNIATERVDALPAERKQGDRPYAIVTDIDETILDNTPNSVYQALRGKDYDEETWGKWCAQADADTLAGALSFFLHAANKGIEVFYVTNRRDNLREATLQNLQRYGFPFADEEHLLTTHGPSDKEPRRLKIQEQYEIVLLIGDNLGDFHHFFNTKEESGRKQALGLTAGEFGRHFIMLPNPNYGSWEPAWYGGKYPPLPERDKALKQLHSQNSR

SEQ ID NO: 412 - protein, 417 aa, Porphyromonas gingivalis
MSTNIDVQQIKQRFGIIGSSPLMEHAIRVAAQVAPTDMSVLVTGESGSGKEFFPQIIHYYSARKHHSYIAVNCGAIPEGTIDSELFGHRKGSFTGAVSDRKGYFEEASGGTIFLDEVGELPLPTQARLLRVLETGEFIPVGASQSQKTDVRIVAATNVNLKEAVANGKFREDLFFRLNTVPIEVPALRMRPDDVPLLFRRFAADSAEKYRMPPLRLSDEARTILMRYRWPGNVRELRNITDRLSILEEERTVSAETITRYLDAEGMQDLHPVVIRRNETTEADKQIPHYEREIIYQVLYDMKKEIADLKGMMNRLAHHEQPSWPVGSDVWGNDDKRTADPKWGVSTHKAPIANAAEPVEPIQEASEYTEDPVSLEEVEKKMISLALERHGGRRKQTAEELKISERTLYRKIKEYGLE

SEQ ID NO: 413 - protein, 602 aa, Porphyromonas gingivalis
MILLFGGTTEGRAAARVLDEAGSPFFYSTKGNLQEIQSSHGHRLTGAMTVADMVSFCRKEEIRLIVDAAHPFAEELHASVAEASEQTGIPVVRYERQYPPREEGIVWCANYDTAAERMLGDGVQRLLMLTGVNTIPKLAAFWKERTTFCRILKRDESVALAEKNGFPAERIVFFEPHADEELMQAVRPDAIITKESGESGYFREKIEAARRMGIRIYAVVRPPLPPSFIPVGGPVGLRRAVERLVPGFFSLRSGFTTGTTATAAVVAAMYRLMGLGSLAEAPVELPSGEIVSLPIAEIREEEDAVVSAVLKDAGDDPDVTNGMAVCATIRLNPEHEEVRFLQGEGVGVVTLPGLGLEVGGPAINLVPRRMMTAEVRRLYAQGGVDITISVPEGREAATQTFNPRLGIRDGISIIGTSGVVKPFSAEAFVGAIRKQVGIATALGANHIVLNSGAKSERYVKGAYPALIPQAFVQYGNFVGESLSCVASFPSVRSVTVGIMLGKAVKLAEGYLDTHSKKVVMNRDFLHELARQAGCSEDIHAIIDSLNLARELWTMPSAEDSDRLLRKIAERSWETCRPSVPSAELELLLIDESGAIRFRIGGE

SEQ ID NO: 414 - protein, 443 aa, Porphyromonas gingivalis
MLRTFRIGGIHPPENKLSAGKPVEVLPIPSQVVIPLGQHIGAPATATVKKGDEVKVGTIIAQAGGFVSANIHSSVSGKVLKIDNVYDSSGYPKPAVFISVEGDEWEEGIDRSPAIVKECNLDAKEIVAKISAAGIVGLGGATFPTHVKLSPPPGNKAEILIINAVECEPYLTSDHVLMLEHGEEIMIGVSILMKAIQVNKAVIGVENNKKDAIAHLTKLATAYPGIEVMPLKVQYPQGGEKQLIDAVIRKQVKSGALPISTGAVVQNVGTVFAVYEAVQKNKPLVERIVTVTGKKLSRPSNLLVRIGTPIAALIEAAGGLPENTGKIIGGGPMMGRALLSPDVPVTKGSSGVLILDREEAVRKPMRDCIRCAKCVGVCPMGLNPAFLMRDTLYKSWETAEKGNVVDCIECGSCSFTCPANRPLLDYIRQAKKTVMGIQRARKQ

SEQ ID NO: 415 - protein, 479 aa, Porphyromonas gingivalis
MKRIQLTLIALFAAVAGLVAQNAYEGVISYKISLDKTGNKVVLNGAADMSNLKLKSTQMIIVTPILRSEDGTSRVEFPSVVITGRNRTKALKREIAFSSALPQAKHAAQYIRRHNGKSEQFAFTGEHAYASWMMDAKFVVREEVRGCAKCPVGLSSNIVPFDPLFNPAEAPYLLAHITPAEEVEKQRESSFDAYINFKVNKADVLPEYRNNKAELEKIKEFVSTVKANPNYSVNKMIIEGFASPEASIAHNKALSERRAKRLAEELVRKYGKTLPNITTEFGGEDWKGLKLAIEKSDIADRDRVLEIINSDKYADDDAREQALKQLSSYRYILDQIYPNLRRNTITMGYIVRDYTLEEAREIIKTAPKELSEAEMYRVAMSYPEGHQERLFALNTTLKYFPESVTGRINLAVAAFNGGDVQQAIALLSPIQTEKGVSNILGAAYARTGDFARAETFFRKAVAEGDANAQRNLDMLLGKK

SEQ ID NO: 416 - protein, 383 aa, Porphyromonas gingivalis
MAEKRDYYEVLGVSKNATDDELKKAYRKKAIQYHPDKNPGDKEAEEHFKEVAEAYDVLSDPQKRSQYDQFGHAGLGGAAGGGFSGGGMSMEDIFSRFGDLFGGFGGFGGFSDMGGGSRRRVRRGSDLRVRVKLSLADISKGVEKKVKVKKQVVCSKCRGDGTEEANGKTTCQTCHGTGVVTRVSNTFLGAMQTQSTCPTCHGEGEIITKPCSKCKGEGVEIGEEVISFHIPAGVAEGMQMSVNGKGNAAPRGGVNGDLIVVIAEEPDPNLIRNGNDLIYNLLISVPLAIKGGSVEVPTIDGRAKIRIEAGTQPGKMLRLRNKGLPSVNGYGMGDQLVNVNVYIPESIDAKDEQAIAAMENSDSFKPTDAARKDIDKKYREMLD

SEQ ID NO: 417 - protein, 293 aa, Porphyromonas gingivalis
MKKLILATLGLMAIAMLSCSSNNKDLENKGEATLLVTFGSSYKAPRETYAKIEKTFAAAYPDQRISWTYTSSIIRKKLAQQGIYIDAPDEALEKLARLGYKKINVQSLHVIPGREYDEMIDFVNKFKAAHSDITVKVGAPLFDTDEDMREVAEILHKRFQQTIEKGEAIVFMGHGTEHAANDRYARINKIMKNYSKFMIVGTVESDPSINDVIAELKETGATAVTMMPLMSVAGDHATNDMAGDEDDSWKTLLTNAGYTVSIDKLDNGNFSALGDIEEIRNIWLKHMKATSAR

SEQ ID NO: 418 - protein, 356 aa, Porphyromonas gingivalis
MTSVSHLRTISVAGILAALGGAVLILFGVNLFLGSVAIPMSEIFRHLFSDRPEGGEALVHYNILWKSRLPEALTAAFAGAGLSVSGLQMQTVFRNPLAGPSVLGISSGASLGVALVVLLSGSLGGVALSSLGYMGEVAMNIAAAVGSLAVMGLIVFVSTKVRSHVTLLIIGVMIGYVATAVIGVFKFFSIEEDIRAYVIWGLGSFSRATDSQLSFFAILMLIFIPAGMLLVKQLNLLLLGESYARNLGLNTRRARLLVISSAGLLIATVTAYCGPIGFLGMAVPHLARVIFHTSDHRILMPATCLIGSALALFCNIIARMPGFEGALPVNSVTALVGAPIIVTVLFRRRRFKEETD

SEQ ID NO: 419 - protein, 757 aa, Porphyromonas gingivalis
MRTKTIFFAIISFIALLSSSLSAQSKAVLTGSVSDAETGEPLAGARIEVKHTNIVAGADAGGHFEIKNLPAGQHTIICSLGGYGQKEEVVAIEAGQTKTISFALRLRTNNLEEVVVTGTGTRYRLVDAPVATEVLTAKDIASFSAPTSEALLQGLSPSFDFGPNLMGSFMQLNGLSSKYILILIDGKRVYGDVGGQADLSRISPDQIERIELVKGASSSLYGSDAIAGVINVITKKNTNRLSAYTSHRISKYNDRQTNTSLDINIGKFSSNTNYFFYHTDGWQNSPFEIKKKKGSGEPVLEETYKKTFRAQENQGVSQSLSYYATNNLSFSGNVQYNKRQIFTPTFSEKKAYDMDYRALTASLGTNYLFPNGLHTLSFDAVYDRFRFGYLYHDKDSSESLINNQGQTEQPTFFPGQLRNKNDQIRYTAEARGVFTLPYAQKLTGGLEYFREELISPYNLITDKADASTLSAYVQDEWKPLDWFNMTAGFRLVHHQEFGTRMTPKVSILAKYGPLNFRATYANGYKTPTLKELFARNELTTMGSHNLYLGNADLKPQMSDYYALGLEYNQGPISFSATVYDNELRNLISFMDIPTSPEHEAQGIKKTKQYANIGKARSRGLDVLCDASIGWGIKLGAGYSLVEAKNLQTDEWLEGAARHRANVHADWVHYWGQYRLGVSLFGRIQSERYYKDGNAPDYTLWRLATSHRFAHFRHIILDGTLGIDNLFDYVDDRPMGVNYATVTPGRTFFAQIAIRFNN

SEQ ID NO: 420 - protein, 331 aa, Porphyromonas gingivalis
MTDNKQRNIVFPAFLLLLGVIAVVTIVGFFMLRPAEEIIQGQIEVTEYRVSSKVPGRIKELRVSEGQQVQAGDTLAVIEAPDVAAKMEQAKAAEAAAQAQNAKALKGARSEQIQAAYEMWQKAQAGVAIATKTHQRVQNLYDQGVVPAQKLDEATAQRDAAIATQKAAEAQYNMARNGAEREDKLAASALVDRARGAVAEVESYINETYLIAPRAGEVSEIFPKAGELVGTGAPIMNIAEMGDMWASFAVREDFLSSMTMGAVLETVVPALNEEKVRFKITFIKNMGTYAAWKATKTTGQYDLKTFEVKATLADKDKAQKLRPGMSVIIRK

SEQ ID NO: 421 - protein, 267 aa, Porphyromonas gingivalis
MRIVSNFLFVSFSVLLFASCRSQREKVVYLQDIQTFNREIIAKPYDVKIEKDDVLNILVSSRDPELSTPYNQVLTTRALARNGYGTNSNEGFLVDSKGYINYPILGQIYVEGLTRTELEKEIQKRIISSGFIKDPTVTVQLQNFKVSVLGEVNHPGSMSVKGERITLLEAIGMAGDLTIYGRRDRVFVIRETDGHREVFQTDLRKADLLASPVYYLHQNDVIYVEPNDKKTQMSEINQNNNVNVWLSVTSTLVSISTLTITIIDKTK

SEQ ID NO: 422 - protein, 569 aa, Porphyromonas gingivalis
MKKTNLFLSLLVIFITGSFMTACAQKSKTNKLTEEDRSRNEYVQSMDVLSNIIGNVRLYFVDTISIKHMTRRGIDAMLGGLDPYTEYIPYEEMDELKLMTTGEYAGVGAIISQRPDSAVIIQRPMEGMPADEAGLIAGDRILTIDGKDFRKSTTPKVSQALKGIAGTVAKVTVMRYGETKPRTFSVKRQKVIMNSVTYSGMLDGSIGYIRLNNFTDKSAEEVRTALLDLRDKQGAKGLILDLRGNGGGLMQAAIEIVNLFVPKGKEVVTTKGRIAESASVFRTLTEPIDTKLPIVVLIDGQSASSSEIVAGALQDMDRAVLMGQKSYGKGLVQTTRQLPYNGVIKLTTAKYYIPSGRCIQRLDYSRTNRTGMATAIPDSLHKIFYTAAGRRVEDAGGILPDIEVKQDTAATLLYYMAINNDVFDFVTGYVLKHKTIAKPEDFSITNEDYAAFCKMMEEKKFDYDRQSGKMLDKLEELAKIEGYLPEANSELKALREKLKPNLSRDLLRFKKEITNYLNNEIVTRYYYERGSIRQSLPEDKVVKEAIKLLKDHPEQIRQILAAPKAENKG

SEQ ID NO: 423 - protein, 981 aa, Porphyromonas gingivalis
MQNKGFVIVITSALAIICAFYLSFSFVTNRYEKKAKAMGDVAGMAYLDSMSNEKVWFGYTLKEAQAQQIGLGLDLKGGMNVILKLNASDLLRNLSNKSLDPNFNKALENAAKSTEQSDFIDIFVKEYRKLDPNGRLAVIFGSGDLRDQITAKSTDADVVRLLKEKYNSAVEASFNVLRARIDAFGVVAPNLQRLEGQGRILVELPGVKDPERVRTLLQRSANLQFWRTYKFEEVSGDLIAANDRLSELAMNNTDATPETEPATTDSVAATADSAAVQAVADSATVAQKEAKDATRKDALFSLLTPVNRGGAVVGVARRANMAQISEMLQQAHDLKVTREDVLFLWGAKAIEDPETKKETDLYELYAIRTNRTGDPDLGGDVVTSAKSDIQNDFGRSEPIVSMTMNEEGARKWARITKDNVGRAIAIVLDGVVYSAPNVNDEITGGRSQISGHFTVEEAGDLANVLNSGKMDATVSIEQENVIGPTLGAESIKAGFLSFLLALVILMCYMCLAYGFLPGLIANGALIVNSFFTLGVLASFHAVLTLSGIAGLVLTLGMAVDANVLIFERIKEELRAGKTPIRAVTDGYGNAFSAIFDSNVTTIITGIILFLYGTGPIRGFATTLIIGLIASFITAVFLTRIVFEKLAKKGRLDKITFTTSITRNLLVNPSYNILGKRKTGFIIPVIIIVLGLIASFTIGLNRGIEFSGGRNYVVKFDQPVSSEAVRSALSSPLQEKVLVTSIGTEGTEVRISTNYKIQEESEETEAEITDKLYQSLKGFYTQQPTADQFLDNIISSQKVSPSMSSDITRGAIWAVLLSMIFMAIYILIRFRDISFSAGVFVSVAATTFCIIALYALLWKILPFTMEIDQNFIAAILAIIGYSLNDTVVVFDRIRETMKLYPNRDRYQVINDALNSTLGRTLNTSLTTFIVMLVIFIFGGATMRSFTFSILLGIVIGTYSTLFVATPLAYEIQKRKLNKAAKK

SEQ ID NO: 424 - protein, 1017 aa, Porphyromonas gingivalis
MKRMTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVMTTSGDPTAVASVEIHGTGSLGASSAPLYIVDGMQTSLDVVATMNPNDFESMSVLKDASATSIYGARAANGVVFIQTKKGKMSERGRITFNASYGISQILNTKPLDNMMTGDELLDFQVKAGFWGNNQTVQKVKDMILAGAEDLYGNYDSLKDEYGKTLFPVDFNHDADWLKALFKTAPTSQGDISFSGGSQGTSYYASIGYFDQEGMAREPANFKRYSGRLNFESRINEWLKVGANLSGAIANRRSADYFGKYYMGSGTFGVLTMPRYYNPFDVNGDLADVYYMYGATRPSMTEPYFAKMRPFSSESHQANVNGFAQITPIKGLTLKAQAGVDITNTRTSSKRMPNNPYDSTPLGERRERAYRDVSKSFTNTAEYKFSIDEKHDLTALMGHEYIEYEGDVIGASSKGFESDKLMLLSQGKTGNSLSLPEHRVAEYAYLSFFSRFNYGFDKWMYIDFSVRNDQSSRFGSNNRSAWFYSVGGMFDIYNKFIQESNWLSDLRLKMSYGTTGNSEIGNYNHQALVTVNNYTEDAMGLSISTAGNPDLSWEKQSQFNFGLAAGAFNNRLSAEVDFYVRTTNDMLIDVPMPYISGFFSQYQNVGSMKNTGVDLSLKGTIYQNKDWNVYASANFNYNRQEITKLFFGLNKYMLPNTGTIWEIGYPNSFYMAEYAGIDKKTGKQLWYVPGQVDADGNKVTTSQYSADLETRIDKSVTPPITGGFSLGASWKGLSLDADFAYIVGKWMINNDRYFTENAGGLMQLNKDKMLLNAWTEDNKETDVPKLGQSPQFDTHLLENASFLRLKNLKLTYVLPNSLFAGQNVIGGARVYLMARNLLTVTKYKGFDPEAGGNVGKNQYPNSKQYVAGIQLSF

SEQ ID NO: 425 - protein, 1014 aa, Porphyromonas gingivalis
MTLFFLCLLTSIGWAMAQNRTVKGTVISSEDNEPLIGANVVVVGNTTIGAATDLDGNFTLSVPANAKMLRVSYSGMTTKEVAIANVMKIVLDPDSKVLEQVVVLGYGTGQKLSTVSGSVAKVSSEKLAEKPVANIMDALQGQVAGMQVMTTSGDPTAVASVEIHGTGSLGASSAPLYIVDGMQTSLDVVATMNPNDFESMSVLKDASATSIYGARAANGVVFIQTKKGKMSERGRITFNASYGISQILNTKPLDNMMTGDELLDFQVKAGFWGNNQTVQKVKDMILAGAEDLYGNYDSLKDEYGKTLFPVDFNHDADWLKALFKTAPTSQGDISFSGGSQGTSYYASIGYFDQEGMAREPANFKRYSGRLNFESRINEWLKVGANLSGAIANRRSADYFGKYYMGSGTFGVLTMPRYYNPFDVNGDLADVYYMYGATRPSMTEPYFAKMRPFSSESHQANVNGFAQITPIKGLTLKAQAGVDITNTRTSSKRMPNNPYDSTPLGERRERAYRDVSKSFTNTAEYKFSIDEKHDLTALMGHEYIEYEGDVIGASSKGFESDKLMLLSQGKTGNSLSLPEHRVAEYAYLSFFSRFNYGFDKWMYIDFSVRNDQSSRFGSNNRSAWFYSVGGMFDIYNKFIQESNWLSDLRLKMSYGTTGNSEIGNYNHQALVTVNNYTEDAMGLSISTAGNPDLSWEKQSQFNFGLAAGAFNNRLSAEVDFYVRTTNDMLIDVPMPYISGFFSQYQNVGSMKNTGVDLSLKGTIYQNKDWNVYASANFNYNRQEITKLFFGLNKYMLPNTGTIWEIGYPNSFYMAEYAGIDKKTGKQLWYVPGQVDADGNKVTTSQYSADLETRIDKSVTPPITGGFSLGASWKGLSLDADFAYIVGKWMINNDRYFTENAGGLMQLNKDKMLLNAWTEDNKETDVPKLGQSPQFDTHLLENASFLRLKNLKLTYVLPNSLFAGQNVIGGARVYLMARNLLTVTKYKGFDPEAGGNVGKNQYPNSKQYVAGIQLSF

SEQ ID NO: 426 - protein, 821 aa, Porphyromonas gingivalis
MKKKNFLLLGIFVALLTFIGSMQAQQAKDYFNFDERGEAYFSFKVPDRAVLQELALIMSIDEFDPVTNEAIAYASEEEFEAFLRYGLKPTFLTPPSMQRAVEMFDYRSGEKYEWNAYPTYEAYISMMEEFQTKYPSLCTTSVIGKSVKDRKLMICKLTSSANTGKKPRVLYTSTMHGDETTGYVVLLRLIDHLLSNYESDPRIKNILDKTEVWICPLTNPDGAYRAGNHTVQGATRYNANNVDLNRNFKDDVAGDHPDGKPWQPEATAFMDLEGNTSFVLGANIHGGTEVVNYPWDNKKERHADDEWYKLISRNYAAACQSISASYMTSETNSGIINGSDWYVIRGSRQDNANYFHRLREITLEISNTKLVPASQLPKYWNLNKESLLALIEESLYGIHGTVTSAANGQPLKCQILIENHDKRNSDVYSDATTGYYVRPIKAGTYTVKYKAEGYPEATRTITIKDKETVIMDIALGNSVPLPVPDFTASPMTISVGESVQFQDQTTNNPTNWEWTFEGGQPAMSTEQNPLVSYSHPGQYDVTLKVWNASGSNTITKEKFITVNAVMPVAEFVGTPTEIEEGQTVSFQNQSTNATNYVWIFDGGTPATSEDENPTVLYSKAGQYDVTLKAISASGETVKTKEKYITVKKAPVPAPVADFEGTPRKVKKGETVTFKDLSTNNPTSWLWVFEGGSPATSTEQNPVVTYNETGKYDVQLTATNEGGSNVKKAEDYIEVILDDSVEDIVAQTGIVIRPQNGTKQILIEANAAIKAIVLYDINGRVVLKTTPNQLRSTVDLSILPEGIYTINIKTEKSARTEKIHIG

SEQ ID NO: 427 - protein, 76 aa, Porphyromonas gingivalis
MRLIKAFLVQLLLLPIFFYKRFISPLTPPSCRFTPSCSSYAIEALRKYGPGKGLLLSIKRILRCHPWGGSGYDPVP

SEQ ID NO: 428 - protein, 859 aa, Porphyromonas gingivalis
MAYDFTQTFRNSLEYSYQEATRLGVVAVTQDMLVLGIIRDGDNGAIDIMRHYGINLYELKRLIELEAIAESLPASPEGSPIFTPSAREAIDDATDICADMEDEAVSPVHLLLSILNSTQESLVQKIFMKQGIKYDTILSDYFGQRNPSEGKSPSEMEILDGYQDNDFDDEEDESSPPSGNSGTGGGSGDAPEQNTGGGDTTTTTRSGGDTPALDTFGTDITAMAAAGKLDPVVGREQEIERVIQILSRRKKNNPVLIGEPGVGKSAIVEGLAERIVNRKVSRILFDKRIISLDLAQMVAGTKYRGQFEERLKAVLDELKKNPQIILFIDEIHTIVGAGSAAGSMDTANMLKPALARGQVQCIGATTLDEYRKNIEKDGALERRFQKVPIAPSTAEETLTILQNIKEKYEDYHGVRYTDEAIKAAVELTDRYVSDRFFPDKAIDAMDEAGASVHITNVVAPKEIEILEAELASVRENKLSAVKAQNYELAASFRDQERRTQQQIAEEKKKWEEQMSKHRETVDENVVAHVVALMTGVPAERLSTGEGERLRTMADDLKTKVVGQDTAIEKMVHAIQRNRLGLRNEKKPIGSFLFLGPTGVGKTYLAKKLAEYLFEDENAMIRVDMSEYMEKFSVSRLVGAPPGYVGYEEGGQLTERVRRKPYSVVLLDEIEKAHADVFNLLLQVMDEGQLTDSLGRRVNFKNTVIIITSNVGTRQLKDFGQGIGFRSEKDEEANKEHSRSVIQKALNKTFSPEFLNRLDDIILFDQLGKTEIRRMVDIELKAVLARIHRAGYDLVLTDEAKDVIATKGYDLQYGARPLKRTLQNEVEDRLTDLILSGQIEKGQTLTLSARDGEIIVQEQA

SEQ ID NO: 429 - protein, 417 aa, Porphyromonas gingivalis
MNYLYILITLLLSGFFSGAEIAFLSSDKLRLELDRNRGDLTGRALNLLYRHPDQLVTTLLVGNNIVLVVYGLLMAGLLAAPLAQWIDNDAMIVVLQSVLSTIIILFTGEFLPKAIFKTNANMMMRVFALPIVAIYYLLYPLSKLFTGLSRSFIRLVDKNYVPTTVGLGRVDLDHYLAENMSGENEQNDLTTEVKIIQNALDFSGIQVRDCMIPRNEMIACELQTDIEVLKTTFIDTGLSKIIIYRQNIDDVVGYIHSSEMFRGQDWQKRINTTVFVPESMYANKLMRLLMQRKKSIAIVIDELGGTAGMVTLEDLVEEIFGDIEDEHDTRKIIAKQLGPHTYLVSGRMEIDDVNERFGLSLPESDDYLTVAGFILNSHQNIPQANEVVEIAPYTFTILRSSSTKIELVKMSIDDQSN

SEQ ID NO: 430 - protein, 293 aa, Porphyromonas gingivalis
MKQNYFKRVCSLLWLVLPMLIMPLEVAAQEIIPNEEVLESLTFVAPVEETDAIEAEVEALQEIVATEEIAEQAVRSYTYTVYRDGVKIASGLTEPTFLDEDVPAGEHTYCVEVQYQGGVSDKVCVDVEVKDFKPVTNLTGTASNDEVSLDWDGVEEKAEEPASDKAVSYNVYKNGTLIGNTAETHYVETGVANGTYIYEVEVKYPDGVSPKVAVTVTVTNSSLSNVDGQAPYTLRVEGKKIIAEAHGMITLYDINGRTVAVAPNRLEYMAQTGFYAVRFDVGNKHHVSKIQVR

SEQ ID NO: 431 - protein, 312 aa, Porphyromonas gingivalis
MIPLSESFESGIPAIWKTIDADGDGYNWMHLTNFTGQSGLCVSSASYIGGVGALTPDNYLITPELKLPTDALVEIIYWVCTQDLTAPSEHYAVYSSSTGNNAADFVNLLYEETLTAKRIQSPELIRGNRTQGVWYQRKVVLPNDTKYVAFRHFNSTDNFWLNLDEVSILYTPLPRRAPCPHPGGYTYSVFRDGQKIASGLSALAYIDTDVPYGTQDYCVQVNYLQGDSYKVCKNIVVANSANIYGADKPFALTVVGKTIVASAFKGEITLYDIRGRLIASGCDTLRYKAENGFYLIKIQVNGTVYTEKIQIQ

SEQ ID NO: 432 - protein, 843 aa, Porphyromonas gingivalis
MKKSFLLAIVMLFGIAMQGHSAPVTKERALSLARLALRQVSLRMGQTAVSDKISIDYVYRQGDAERGITSQEEGSPAYFYVANRGNNEGYALVAADDRIPTILAYSPIGRFDMDSMPDNLRMWLQIYDQEIGLILSGKAQLNEEILRTEGVPAEVHALMDNGHFANDPMRWNQGYPWNNKEPLLPNGNHAYTGCVATAAAQIMRYHSWPLQGEGSFDYHAGSLVGNWSGTFGEMYDWINMPGNPDLDNLTQSQVDAYATLMRDVSASVSMSFYENGSGTYSVYVVGALRNNFRYKRSLQLHVRALYTSQEWHDMIRGELASGRPVYYAGNNQSIGHAFVCDGYASDGTFHFNWGWGGVSNGFYKLTLLSPTSLGIGGEGIGFTIYQEIITGIEPAKTPAEAGTDALPILALKDIEAEYKSESGLNVGYSIYNTGEEQSNLDLGYRLNKADGEVIEVKTSSINISWYGYGEHPESFSLAPNQLSQGINTITLLYRRTGTEQWEPVRHAQGGYVNSIKVNTTDPNNVVVTVDNNEGKLSIVPNSFVADLNSYEHSTITVQFNSDSPDEIRTPVAFALSTGATADDVISLGWVMAEVPGGSSNYPVVWSKDVLTLSEGDYTLWYRFSINNQKDEWKKIGSVSVKTPTEYTHPLFEVGHNQTSTYTLDMAHNRVLPDFTLKNLGLPFNGELVVVFRQTQSSSGSLWAAQETVHIKQGETFVYKPVVEGPIPDGSYRATLHAFVNGQQQLYLKGKRNYTVKIVNGTAVEAIESSEEIRVFPNPARDYVEISAPCIPQETSIILFDLSGKIVMKNSLSAGHGRMDVSRLPNGAYILKVDGYTTKINIVH

SEQ ID NO: 433 - protein, 290 aa, Porphyromonas gingivalis
MKKLFLSLTSLVMVFAVASCDIIDKDQTLLPAPTNVTPDNPDDNPSEIDITQTHTEKYVLAEEFTGQKCLNCPKGHRKLAALKEQYGKRLTVVGIHAGPGSLVPPLFRTEAGDAYYSKFANNTPLPALMVSRKKFGSSYVYDKSYKTWDVPIAEQMEQKAKINIFAVAEYTDTQKIKVTVKGKILEGNTLPKSMVQVYLLEDKLIAPQVDGNTTVENYEHNHVLRGAVNGIWGEEFVNLKDYLYTYAVEPLSGMSFVAENYSIVAFVYDVQTFEVYDVVHVKINPQSDGK

SEQ ID NO: 434 - protein, 223 aa, Porphyromonas gingivalis
MKKSSVVASVLAVALVFAGCGLNNMAKGGLIGAGVGGAIGAGVGNVAGNTAVGAIVGTAVGGAAGALIGKKMDKQKKELEAAVPDATIQTVNDGEAILVTFDSGILFATNSSTLSPNSRTALTKFAANMNKNPDTDIRIVGHTDNTGSDKINDPLSERRAASVYSFLNSQGVSMSRMAAEGRGSHEPVADNSTVAGRSANRRVEVYILPNAKMIEQAQQGTLK

SEQ ID NO: 435 - protein, 337 aa, Porphyromonas gingivalis
MSKKSILLLCCSLCFISATKAVTPVRNVRNSQVNSKAKTERTKPSDSVRYISNMIADRLEFRNKISSEKEVRKAEYENRLAMEALNYPAIDLYGEDSWSEYVNPFVGAGTDVEIPNSYDIDCSSFVMPVEDKQVTSQFGYRRRFGRMHYGIDLSVNRGDTIRAAFDGKVRVRSYEARGYGYYIVLRHPNGLETVYGHMSRQLVDENQIVRAGQPIGLGGSTGRSTGPHLHFETRFMGIPINPSTIIDFDNGVPLRDIYTFKRGSNSRYAKASKTSSRYAKKGKKGRQASSPMTYRIKKGDTLETIAKRHGTSVQKLCATNGIGKSKILTPGKALRIK

SEQ ID NO: 436 - protein, 151 aa, Porphyromonas gingivalis
MAKINFYAEGVSLPRIRRRIVGKWIAEVCSRYGKAVGEISYLFCDDEYILKANQEFLDHDYYTDIITFDSCEADTVNGDLLISLDTVRSNARALDLRYEDELHRVIIHGILHLCGLKDKSKKDEAQMRAAEEKALVMLRETIGSELSLLHT

SEQ ID NO: 437 - protein, 391 aa, Porphyromonas gingivalis
  MOD_RES (241)..(241): Xaa can be any naturally occurring amino acid
MKVKYLMLTLVGAIALNASAQENTVPATGQLPAKNVAFARNKAGSNWFVTLQGGVAAQFLNDNNNKDLMDRLGAIGSLSVGKYHSPFFATRLQINGGQAHTFLGKNGEQEINTNFGAAHFDFMFDVVNYFAPYRENRFFHLIPWVGVGYQHKFIGSEWSKDNVESLTANVGVMMAFRLGKRVDFVIEAQAAHSNLNLSRAYNAKKTPVFEDPAGRYYNGFQGMATAGLNFRLGAVGFNAIXPMDYALINDLNGQINRLRSEVEELSKRPVSCPECPEVTPVTKTENILTEKAVLFRFDSHVVDKDQLINLYDVAQFVKETNEPITVVGYADPTGNTQYNEKLSERRAKAVVDVLTGKYGVPSELISVEWKGDSTQPFSKKAWNRVVIVRSK

SEQ ID NO: 438 - protein, 385 aa, Porphyromonas gingivalis
MTYRIMKAKSLLLALAGLACTFSATAQEATTQNKAGMHTAFQRDKASDHWFIDIAGGAGMALSGWNNDVDFVDRLSIVPTFGIGKWHEPYFGTRLQFTGFDIYGFPQGSKERNHNYFGNAHLDFMFDLTNYFGVYRPNRVFHIIPWAGIGFGYKFHSENANGEKVGSKDDMTGTVNVGLMLKFRLSRVVDFNIEGQAFAGKMNFIGTKRGKADFPVMATAGLTFNLGKTEWTEIVPMDYALVNDLNNQINSLRGQVEELSRRPVSCPECPEPTQPTVTRVVVDNVVYFRINSAKIDRNQEINVYNTAEYAKTNNAPIKVVGYADEKTGTAAYNMKLSERRAKAVAKMLEKYGVSADRITIEWKGSSEQIYEENAWNRIVVMTAAE

SEQ ID NO: 439 - protein, 190 aa, Porphyromonas gingivalis
MEFFMLFIAAVFVNNVVLSQFLGICPFLGVSKKVDTSIGMGAAVTFVLALATLVTFLIQKFVLDRFGLGFMQTIAFILVIAALVQMVEIILKKVSPPLYQALGVFLPLITTNCCVLGVAILVIQKDYTLLQSFVYAISTAIGFTLAMVTFAGIREQLDMTNLPKAMKGIPSALLAAGILAMAFMGFSGIA

SEQ ID NO: 440 - protein, 186 aa, Porphyromonas gingivalis
MLFIAAVFVNNVVLSQFLGICPFLGVSKKVDTSIGMGAAVTFVLALATLVTFLIQKFVLDRFGLGFMQTIAFILVIAALVQMVEIILKKVSPPLYQALGVFLPLITTNCCVLGVAILVIQKDYTLLQSFVYAISTAIGFTLAMVTFAGIREQLDMTNLPKAMKGIPSALLAAGILAMAFMGFSGIA

SEQ ID NO: 441 - protein, 833 aa, Porphyromonas gingivalis
MKQLNIISFIIAFLFLGTSASAQQSGGSVTGTVVDKSSKEPIAYVQVFVKGTTLGTSTDANGNYSIKGIPSGNQTIVARLMGYSTCEEKVHIEKGGSRHVDLYLTEEILSLDGVVVSANRNETFRRQAPSLVTVLSPELFLKTNSTNLSQGLKFQPGLRVEDNCQNCGFNQVRINGLEGAYSQILIDSHPIFSSLAGVYGLEQMPANMIERVEVIRGGGSALFGSNAVGGVINVITKEPLRNSAEISHSTMTFDHAKGWGSFQNTTQFNGSMLTEDRKAGVMVFGQHNYRPGQDIDGDNFTELPNLRNRSLGFRSYYKTGLYSKATLEYHSMQEYRRGGDRLDNPPFEAQIAEYLQHYINGGSFKFDQGFSGGKDFFSLYASAQDVQRRSYYGGGDYTENLLNGAVQSGSTESDEYNDAFTALTSYGTTKGFDLQGGGMYRHTFGENWDFTGGLEYIYGQLDDRSGYRPSKIDQNTSTFSQYDQLEYKTEKLSALIGARIDYVLLNQDGKRYIDPLFIFSPRANVRYNPNKNLSFRLSYSEGFRAPQYFDEDLHVELAGGTPISRVLSPNLKEERSRSISASFDYYHRADEWQFNIMGEAFSTFISNQFKPSDKVETTSDGKEWIIRTIYNDKDGVSKVYGVNLEGRIAYNKSFDLQLGGTWQRSRYGSIYTAVEADKTTGQAEISVKDYVRTPNLYGYFVATVRPTEHFAINLSGTFTGKMDVVHEAYEGDIPAEHIAPDGSFDFEMNGQQFKGLAEGHAKLVKTPAFADIDLKLSHDFHLASTMTLELNAGIQNIFNSYQKDTDKGPGRASTYVYGPMQPRRIFVGTKINF

SEQ ID NO: 442 - protein, 891 aa, Porphyromonas gingivalis
MYKKIIAVAALFCASIGILKGQSSDLTPQDTIYSPEISYAKPIHKTIASIEIEGMRSFDDFVLRNLSGLAVGDEVLIPGDAMSAAVNRIMRQGYFSNVRIIADKYVGNKVYLKIIVTERPRISKVTFSGVKKSEREDLEMKIGLREGIQMTRNNEDKVRQIVQKYFSEKGYRDASIRITQEPDLSKDGFVNVLISIEKKSKTKVNEIYFSGNKALSNHKLRMAMKNTNAKFSLRKHIRSSFLKLFSTHKFVEESYREDLVRLIEKYQEYGYRDAEILTDSVVKAPDGKRVDIYLNIEEGQKYYIKDVNFVGNSQYPSEYLERVLGIKSGDVYNQRRLAKRLNEDEDAVGNLYYNNGYIFAWVDPVETNVVGDSVSLDIRIAEGKQANINKVIIKGNTVVYEDVVRRELYTKPGQLFSREDIINSIRLINQLGHFDAEKSIPRPIPNPETGTVDIEYDLVPRSSDQLELSVGWSQSGLLFRGAIKFTNFSVGNLLHPSMYKKGIIPQGDGQTLSLSAQTNGKYYQQYSVTFMDPWFGGKRPDMFSFSAFYSKTTAIDSKFYNSNAGNYYNAYYNSYYNNYNSYYNGMSNYTGDLYTQASDPDRSLQMLGTSIGYGKRLTWPDNWFQIYTSLNYTYYRLRNWSYNTFQNFHHGSANDLNLELRLSRTSIDNPIYTRSGSDFMVSVAATLPYSLWDNHDYASQNLSVSDRYRFIEYHKWKFRGRVFTPLLNPATHKYTPVLMSRVEGAVLGSYNSNKKSPFGTFYMGGDGMSSYYGGYMNETIGLRGYKNGSIAGNNYDYAYAYMRLTMELRFPILFENSFNAWLLAFAEAGNAWRSIDNYNPFNLKRSAGVGLRVTLPMVGMLGIDWGYGFDRPDNSLQRGGSNVHFVLGQEF

SEQ ID NO: 443 - protein, 174 aa, Porphyromonas gingivalis
MNGDMKRFLILIGFALAVAFSGFSQKFALVDMEYILRNIPDYEMMNEQLEQVSKKWQNEIEALENEAQSMYKKYQSDLVFLSAAQKKTQEEAIVKKEQQASELKRKYFGPEGELYKKRSDLMKPIQDEIWNAIKEIAKRNNYQMVLDRGTSGIIFASPSIDISDLVLSKMGFSK

SEQ ID NO: 444 - protein, 170 aa, Porphyromonas gingivalis
MKRFLILIGFALAVAFSGFSQKFALVDMEYILRNIPDYEMMNEQLEQVSKKWQNEIEALENEAQSMYKKYQSDLVFLSAAQKKTQEEAIVKKEQQASELKRKYFGPEGELYKKRSDLMKPIQDEIWNAIKEIAKRNNYQMVLDRGTSGIIFASPSIDISDLVLSKMGFSK

SEQ ID NO: 445 - protein, 163 aa, Porphyromonas gingivalis
MKKFFLMLLMALPLSLLAQKVAVVNTEEIISKMPEQVAATKQLNELAEKYRLDLKSMDDEFAKKTEEFVKEKDSLLENIRNRRQQELQDIQTRYQQSYQTMQEDLQKRQQQLFAPIQQKVADAIKKVGDEENCAYIMEAGMMLYTGATAIDLTAKVKAKLGIK

SEQ ID NO: 446 - protein, 827 aa, Porphyromonas gingivalis
MKEAIPRKNKYIKLNGIYRLSFILLCCLLCSQAAMAQGVRVSGYVLDRGEKPIPFAGVKVRGTGTGATTNLKGYYEFRMKATTDSITIEFSSMGYQGVSRSFPSLTKDTRLNVRLAEAEMELSSVTVQATKRRLNTMERVNTRDLRVNAGPTGGVESLISTYAGVTQNNELSSQYSVRGGSYDENMVYVNGVEVYRPLLVRSAQQEGLSFVNPDLTQSVQFSAGGFTADYGDKMSSVLDIRYKQPQEKEGAVLLGMLQSSAYYGSSAGAFSQITGVRYKSAKSLLGTTDTKAEYDPIYADGQTFMTYRFSPKLSVSFLGNISQTRYKFVPQTRETSFGTLSDAKKLKIFFDGQEQDRFLTYFGAFSMNFVPDDKQRHTVTLSAFNSNERETYDIQGEYFLNDVQLGADGTASMASGSENSNGLGIGRNHEHARNRLSYRVLNMGYRGEMKLNEKHRLQAGVSAQMEKIADHISEWERRDSVGYNLPHSETVLLMYNNLYADTQMRGTRLSAFVQDRFNFSMGGGTFSLIPGIRASWWSFNKELLVSPRISVGYSPESNPALVLRAAAGLYYQAPFYKELRQTHKDAEGNNVVVLNEKIRSQGAFHILAGADYTFEMGGRKYKFTAEAYYKSLFNINPYIIENVKIRYLGENIGSGYAAGIDLKLFGELVPGVDSWLTASIIKARQKLDGYGSLPLMNAPTYNFSFFLQEYVPGNKRITATLRAALSGGLPQLNPSKGLSSPAFTAPAYKRVDLGVMYKWLDPDDSFAGRSKWLMGVKGAYIGADLFNLFDMTNVNSYYWVSDAYQQQYAVPNYLTRRQFNLRLLVEF

SEQ ID NO: 447 - protein, 672 aa, Porphyromonas gingivalis
MYSGHHKIHYPFLILLVCLAFAACKSVKLKDAEKAHDRQEYTKAADMYNTLYRRTRRKQVEMKAYTAFRSGENYRAAGRQAKALRGYLNARRYGYPDSVVLLRLAQTYQQGGNYKEAEVLFRGYLEAYPKSYFAAIGLEGCLFARQQKEYPTRYRIRRAAEWNSARGDFGPAYAPDASALYFTSSRSKDDGLDNSSITGLKPNDIYIIKRDAQGRWGRPDSVSGGINTPWDEGVPTITPDGSTIYYTLAQQGADYDRTVQIYSAARSGEGGWSNGSLVDIMRDSLRMAAHPSMSASGDYLYFVSNIGGSYGGKDIYRVKVSDRSYGSPENLGPDINTPGDEMFPFIDGDSTLFFASDGHAGLGGLDIFKATLDSTGQWHVVNMGQPVNSSADDFGLAVEPKGKNKEEALPDNGVKGVFCSNRGDARGWPHLFHFELPAIYTEIQGYVMDREENPIAGATVRIVGERGPVGQGFVTTRDDGSYKMSVQGDTRYVMLAGASGYLNQYVELKTDTAKQSETYYVDFFLASREKAEGLQNIFYDFDKATLRPESMKSLDELIRILTDNPDIRIELGSHADRKGPDAYNLGLSDRRAKSVVDYLTSRGIAADRLTWKGYGKSVPKTVTAKIAERHDFLKEGDVLTEEFVAPLTEEQQSVCDQLNRRTEFRVIEEELR

SEQ ID NO: 448 - protein, 708 aa, Porphyromonas gingivalis
MKKFFFALLSIGISAQAFAKTDNVPTDSLRVHNLQTVTVYSTRTAVPLKKIPAKMELISSRNIKQSGFNNMTDILKTQSSLDVIQYPGFSSNIGIRGFKPSGKYVTVLVNGIPAGTDNISTLNTSNIEQIEILKGPFSSIYGTNAMGGVVNIITHKSKDKIHGNVSLFGGSYQTMAGSFNLGGRFEDIFSFDLSLGLDKQNKDYKTGSNNFLSLSKLEEAIVDVNATKNKKMKGSDYTVATGRLRFGIDFTPEWSLNLYQNVFLGDAIPVGGSIWGVYGESKKNLNRSSTSFELLGKHGCHTLQFSPYFNIEKSENYNNADPTGFINYKSDYYTYGALLQDKISFGGQNIVLGVDSRNMTMESERFEQAGVNTKPYNPGYATNNIGLFGQANFYLLNDALSISAGARADFMFFDLKANEYLNNEAKQETHNVINPNVGIKYEFVKGLTAHGTFGSAFSAPDAFQKAGQYVGPFGTTIGNPDLKPEKSMTWDFGIGYSNARCGIQADVTLTYFHTDHKDLILSSPDYANNITTYINADKARMSGIEALLSYDFGSLFANKFSLRAFANATIMLNSEMKKSQTDAPWSEMYYVRKQNITFGIEYRGKEGLEVMLNGRFMGRRIEQNWYAYYPEVRPELQQLLAAEEPELAAQGLLRHPQAMVFNASAYYHMNKYLTFGVNLNNILDELYTEKDGYHMPGRNIMGKVMVNF

SEQ ID NO: 449 - protein, 462 aa, Porphyromonas gingivalis
MNRFSNHWPCILVGFVLWFVSASRTVAQNASETTVSYDTDTAVLSEADVLRIALSENATVKVADMDVRKQEYARRAARADLFPKVDLNGVYSHTLKKQVLYIDMPGFSSSEGIEMGRTHNTQGGVNVSMPLVSAQLWKSIAMTGEQLDLALEKARSSRIDLVAEVKKAYLSVLLAEDSYGVFKRSYDNALANYKNISDKFDRGLVAEYDKIRANVQVRNIEPNLLQAQNSVALALWQLKVLMSMEVETPIRLSGSLSDYKEQVYTGYFAADTLISNNSSLRQLDIQRRLAVSADKLNKYSFLPTLNLGGQYTYSLNSNDIKFWGEGQRWTPFSTISLSLYIPIFNGGKRLYNVKQSALSIRQIDLQRRHIEQSIRMGIKNQNDRLRTCMQRFVASEEAVRSAEKGYQIAEKRYQTGEGTLVELNDADVALLQARLNYNQAIFDFMTAKAELDKMNGMGIPEQ

SEQ ID NO: 450 - protein, 492 aa, Porphyromonas gingivalis
MWGDSHGVAPNQVRRTLVKVALSESLPPGAKQIRIGFSLPKETEEKVTALYLLVSDSLAVRDLPDYKGRVSYDSFPISKEDRTTALSADSVAGRRFFYLAADIGPVASFSRSDTLTARVEEVAVDGRPLPLKELSPASRRLYRGYEALFVPGDGGSRNYRIPAILKTANGTLIAMADRRKYNQTDLPEDIDIVMRRSTDGGKSWSDPRIIVQGEGRNHGFGDVALVQTQAGKLLMIFVGGVGLWQSTPDRPQRTYISESRDEGLTWSPPRDITHFIFGKDCADPGRSRWLASFCASGQGLVLPSGRITFVAAIRESGQEYVLNNYVLYSDDEGDTWQLSDCAYRRGDEAKLSLMPDGRVLMSIRNQGRQESRQRFFALSSDDGLTWERAKQFEGIHDPGCNGAMLQVKRNGRDQVLHSLPLGPDGRRDGAVYLFDHVSGRWSAPVVVNSGSSAYSDMTLLADGTIGYFVEEGDEISLVFIRFVLDDLFDVRQ

SEQ ID NO: 451 - protein, 245 aa, Porphyromonas gingivalis
MKKEKLWIAIVAGLAFVLGLYALGRSVAQLRRSQPSVTVTGMAERNFKSDLIVWTASYQLQMMDLESAYKALKEKQILVADYLKNKQLPDSSYIFSSVAISKEYNYYYDPRQEQNVRTFAGYLLSQTVTVTSQDIEHVEKISRDITELINQGVEITSDRPAYYYTKLNDLKVEMLRNASEDAFNRASVIAEGSGSSVGKMLSSSMGVFQIVGLNSNEDYSWGGSFNTSSKMKTASITVKASFALK

SEQ ID NO: 452 - protein, 276 aa, Porphyromonas gingivalis
MKKTIAIIASALLALGAVGCKKNADTTAVSEKDSIALSMGILYGQDFANQFEMSRLQGQPIDSVAFLDGFKYGIDTTRFSYNLGAIYASNIARQLAHDSIDIDKFYAAMRAALLKDTVSIAMKPADAQAFMQRIQAKKQRENNMKQFGQNIEKGNEYIDTFKKEDGVTVTTTGLAYKTLQEGTGATPSLADTVRVKYVGTLVDGKEFDKNEEGIEFAVTGVIKGWTEMLQLMKVGQKVRVVIPQELAYGETGNYTIEPFSTLTFEMELIGIKPGKK

SEQ ID NO: 453 - protein, 775 aa, Porphyromonas gingivalis
MKVLRQVFLPILFVLLTGACSTTKNLPEGEQLYIGMGKTQILRQDKSHAGQQALTEVESTLKVTPNGAIFGSASASLPKIPFGLWLYNSFVGDSTVISKWIFDKFAAKPVFISQVKSDSRAKVATNILREHGYFDAKVKSSVTTLKKDSLKAKISYTVDMASPYHYDSIIPLPISTFPDSILAYRQTPSLIRKGDQFNLAKLHEERQTISALLRDNGYYYFRPQDIIYEADTLLVRGAVCLRAKLSEDTPPQAMRPWRIGKRTAVLLGMNGESPTDSLEVEDMKVLYYRKMPVRPKILAKRFRFFSGNLYRQKDDETTRKSLARLGAFSVIDLNFLQRDSISGLLDVRLLTTLDKPWDASLETLFTSKSNDFIGPGLNFALARRNVFGGGENLSWNIGGSYEWETGNRPENSSNRLIDINSYNMNTAVNLSFPSIVFPGLLDKYYYYPTTTTFQASATALNRAHYFSMYSFGFSTTYEFQPSKEHRHAIFPLKLNYNLLGHQTETFQAITANNPPLLLSLQSQFLAQMGYIYTFNKSVSEKSPHHLWMQFGLSEAGNLLNLIYLAAGKKYSDTKNFVGVPFSQFIKATGELRYSYTIDRNQSLATRFGTGVIYSYGNMRVAPYSEQFYVGGANSIRAFTVRSIGPGRFNPDSDNQYSYLDQVGEFKLEANVEYRGKLFGDLHAAVFLDAGNVWLLREDSSRPGGALSEVGSVSNFLNSIALGTGVGLRYDLAFLVVRVDVGFGLHLPYNTGKKGYYNIPRFKDAIGFHLAVGYPF

SEQ ID NO: 454 - protein, 774 aa, Porphyromonas gingivalis
MSSHSVRYLIGIAGCLLLMLASSCSVTRYVPDGSRLLDRVTIASETGSIALPEDIRDYTLQQPNYRLFGMTRWLLRVYSSSNPNSNSWWNRSLRKMGEPPVLIDSVLTDRTANRLAKAMAGDGFLDATARAVVDTGLYKKARITYLIQPGSRYYIRNMALDVKNPLLPPVALGNSLPSAYKVGISEGSPLSPIVLDEERKAIARHMRNNGFWKFSAEDVYYEADTTVSGGSGTKSADLKLVVNGIGRYPYRIGRVFFHADYDPLESDFRVQELPRIDSISRGDYTVYYGSRGRYIRASALTRSVSVTPGAFFCEDDVERSYIKLNALPIVRNVNIRFVEHNGKDEIALADSSRLVDCYILTVPAKSKSFEAEVLGTNSAGDFGAALSLGFTDRNLFRGAEMFNIKLKGAYEAIRKGSHSFMEYGVESSLRFPRLLFPFISDETRRRLRASTEWKIGYNYQTRPEFDRVILSAQLNYSWQTYLHNRLRHTIRLLDVDYLHLPYIDPDFAQSLPPTTALYNYTEQFILGSAYILNYTTASSMERTVSNPFTARFSIQTAGNLLQAISYLTDSPKDEHGLYKMFGLHYAQFVKLDLDLAKTVLLEKDNTLALHLGFGLAFPYGNARHIPFELRYFAGGSNSVRGWSVRTLGPGSMKMTPDKTFFDQMGDIRLDLNVEYRTKLFWKFRAAAFVDAGNVWTIKEYENQEDGLFRFDRFYKEIALAYGLGLRLDFDYFLVRLDAGLKAYDPQQTGRYKWAITRPNLSSNFAWHIAVGYPF

SEQ ID NO: 455 - protein, 867 aa, Porphyromonas gingivalis
  MOD_RES (384)..(384): Xaa can be any naturally occurring amino acid
MRKRILQLFLTALLLALGSSLAIAQTVVTGKVIDSETSEPLIGVSVSTGQGASLRGVTTDMDGGFRFEVPAKSVLTFRCVGYATVTRSIGRGSQEDLGTILLDPQAIGLDEIQVIASVVPKDRMTPVPVSNIRVADIQAASLNVEFPELVKSTPSTYTTKGSGGFGDGRTNVRGFDTYNFGVLINGVPVNGMEDGKVYWSNWSGLMNQASTIQIQRGLGASKLGISSVGGTMNIITKTTDANTGGSAYVGMGNDGLHKESFSISTGMNDGWAITIAGSHMTGLGYVKGLKGRAFSYFFNVSKKFNERHTLSLTGFGAPQWHNQRSSKYSVADYDKYGIRHNQSFGYLRGELTPTAYAYNTYHKPQFSLNHFWKMDENTSLYTAXYASLATGGGRRAYGKNSKWVLINYNTGQPYEQTKVTPDGLIDYDAVLAANAAASNGSEAIFALGSNSHKWFGLLSSFKKKLNSSLTLTAGYDGRYYRGDHYDKITDLLGGSYYIEDPKTKLAYHAEGQQLKVGDIVNRDYTGEIMWHGLFAQMEHSSEWIDAFVSGSINYELYRNHNYGGSKSTGYLPGVSPWKSFLPWSGKAGLSYKFAQGHNVFANGGFFTRAPLFGNIYAAGAIIPNDKANMEKVLTGEVGYGFTNHKNFEFNINGYYTKWMDRVTSKRIGNEYVYLNGVDAVHCGVEAEVSYRPIRQIDLRGMFSLGDWTWQNNVSYTSYDEAGNETGQDITYIKGLHVGDAAQMTAAVSADIELFKGFHVIGKYNFLGKNYAGFNPATRNAQQYEADGKEIVESWKLPDVGLFDLSASYNFKLGSLSTTFYFNMDNVADKRYVSDADDNIIGKKHDEASALVWYGFGRTWSTGIRVNF

SEQ ID NO: 456 - protein, 431 aa, Porphyromonas gingivalis
MKFSIRLFLCIIFLLSAFILPALGQKSKQVQRLEKQRKEALKAIEKTDRELRNTKKDKQDKQKHLNLLNKQVAQRKQMVQLLDNEVKELQSDIDSMTGVCHQLSVEEKARSDEYAQALQSMQKRKRSLDRILFISSAKSFDEGMRRMRFLEQYASAYKLASVRLRDTRSKLETERATVEDAKKEKGHLLVIREEEKKKLEGQQAEQRRQVQALGAKQKDLEAQLRKQKKQAEALNRKIEKQIAKEIEAAERRAREERERLAREAKAKGKPVPAEPERKAETKGGYAMDASERALSGSFAQNKGRLPGPVRGRYRIVSDFGVHQHSELKKVQVNNGGIDIAVATGSDATSVFDGVVSSVFVIPGYNSAVMVRHGNYITVYANLSKVYVNSGTRVKTGQALGRAYTDPSNNQTIIHFEIWKERSKQNPRLWLR

SEQ ID NO: 457 - protein, 333 aa, Porphyromonas gingivalis
MKKYLLYASLLTSVLLFSCSKNNPNEPVEDRSIEISIRVDDFTKTGEAVRYERNQGSAAERLITNLYLLLFDQSGANPAKYYITGNTFTGGTWLPDDMKVKLDMTQSEAGERKVYVVANVDNAVKTALDAVANESDLQTVKRTTAMPWSTDIASPFLMSGNKTHDFLANRLLDNVPLVRAIAKVELNISLSEKFQIVPIIVNGSLSEFKFRYVNFDKETYVVKPTTKPDNLISSANGVWPQITDWTVWGASLNTSPAPDAGTGYTLDANGKVTALRIVTYLNERDSKGATVEVALPRVDDGTLPPPEFGPELYRLPLPDKILRNHWYKYEVEI

SEQ ID NO: 458 - protein, 315 aa, Porphyromonas gingivalis
MIRTILSRYVSSNFWSRGATFFFTIFPAFILAATALPACGGGTASGSDRTLAVTIEPQKYFIESIADKSVQVVALVPAGSNPEEYDPSPTVMKRLSEADAYFYIGGLGFEQRNLAAIRDNNPKLPLFEMGKALADAGSADLHGSCTDHSHTDLHAHDPHYWSSVVGAKALSRAAYDALVELYPNEKDKWDKGHDRLNGRIDSVKRLVDTMFANGKADKAFVIYHPSLSFFAQEFGLRQIVIEEDGKEPTAAHLRRVIDQARADGVRIVFIQPEFETRQAEDIAREIGARPVRINPLRSSWEEEILHIARALAHER

SEQ ID NO: 459 - protein, 848 aa, Porphyromonas gingivalis
MIGKKIFFILLALIAFSGLNAATDTEFKYPTDANIIGHVKDSKTGEHLVGITIAIKGTTFGTSTDATGHYYLRNLRPGEITLIMRGMGYKSQERVVRVEKDKTIEVNFEAEEDAINLDEVVISANRELTLRRLAPTLVNVLNEKVFSQVNASNLAQGLSFQPGVRVENNCQNCGFNQVRINGLDGRYAQILIDSRPIMSALAGVYGLEQIPANMIERVEVVRGGGSALYGSSAIAGVVNIITKEPSHNSFTFNESLSFTGFSKLDNNTNFNASIVSDDNRAGAMVFGQARYRNHWDANNDGYSELGKIDARSLGAHSYLRLSDYSKLTGEFHTISEFRRGGDRIDLPPHVVGVAEQTDHSVFSGNLKYDLFSSNYKHHFQAYTSGQIVNRKSYYGGIGEIDVNGHPGGTEGYPIPQDQYGNNYGVTKGKTYMGGIQYSYDLDKFLLMPSQLLFGAEYTRDELNDVMPILSWQTGEDANGNTIPLYPELDQNINNYSLFGQNEWKNDRWSILVGARLDKHSEVKDMILSPRTTLRFNVNPDINLRATYAKGFRAPQVFDEDLHVGVVGGEAQKVFNDPNLKPEISHAFSLSADMYHRFGNVQTNFLVEGFYTRLLDVFTNEEQPDQHDGIKRYTRINGSGAKVFGLNLEGKVAYKSFQLQAGLTLASNKYDEAQEWGLNTVKDTNGAFVTEANANGQQEYKNESMTDTQITRTPSVYGYFTLAYNPAHSWNIALTGAYTGQMYVPHAIEYGVKSAELDIMQNNPEITDETGKAPRIDELKKTPAFFDLGLKVGYDFHVFQATEVQLYVGMNNIFNSFQKDFDRGAARDSGYIYGPTQPRTGYMGLVVKF

SEQ ID NO: 460 - protein, 202 aa, Porphyromonas gingivalis
MTVKRAVRIALLTLIGILFSSPSLVRAQSLFSTEHVLQLYNKILYGESAADTVAEKTAGESAFPFIDKLINLGRTFLGKPYRYRGPSPWPMDCSGYVSYLYSKFDIKLPRGAAAQSQYTNPIEREDVRPGDLLFFKGRNARSNRIGHVALVVSVDEDDITMMHSRNSRGIVIEKLNRSAYFSRRLVSYGRVPGAKRVIPRKS

SEQ ID NO: 461 - protein, 455 aa, Porphyromonas gingivalis
MKRTILLTALTVLSSLSLLRAQNESEASTNPMSGLSLEDCIRIAKERNLNLRRQEIEQENRIISLDAARHSFLPSVNAGIGHNYSFGRSKDKTGVTVDRSSMNTNLSIGASVEVFSGTRRLHDLKQQKYNVEDGIARLQKAREDLSLQIAALYINLLFRQEMTRTAETQLALIREQRNRTAEMVRVGKWAEGKLLDINAQMAKDEQLLVQYRSEEELARLDLGQALELEHPESIAVKAPDTDVLVAERLGSLLAPEEIYRTALGLKPALHSSELQIASAREGLASARAAYFPTLSLSAGYSNGYFRDLGKEYAAINPSFSEQWKNNGSYSIGLSLNIPIFSAMQTQDRVRSSRLQIRSSELRLVEEKKALYKEIRQAYSNAVAADKAIAAAENSKAATLKAYEYARDSFEAGRLSAYEYAEAKTKYALSQVEELRAKYDFIYKAKVLDFYQGKDF

SEQ ID NO: 462 - protein, 444 aa, Porphyromonas gingivalis
MRFQHYLICTAAVAALAANPLTGQSNMTLEECIDYARRHSSAVALSAAELEQSKADYLQAVGNFLPRVSAGTGASWNFGRGLDAETNTYTDINSFNNSYSIHATMTLFDGLQSVYRLRMAHARREASRLSVREQQELAALGTTEAYYDLVYARQMQELAMQKYEESSRLHRQTARMEELGMKSRPDVLEMQSRMAGDRLALTQADNQCIIALIRLKEKMNFPIDDELVVDDMPADSLSADMAESDSSAGVFARAAHHHPVLLRAKLDEQAATDRLRAARGAFLPSVSVSGGWNTGFSRFLNGSDYTPFSEQFRNRRGEYVSLNLSIPIFSGFSLVSHLRQARAERRAAIVRRGEAERRLYSEIAQAMADRDAALASYRQAKEHTDAMQTAYEAVLQRYEEGLNTAIDLTTQANRLLDARVQRLRAAMTYRLKCKLIAYYGCLSD

SEQ ID NO: 463 - protein, 940 aa, Porphyromonas gingivalis
MNKFYKSLLQSGLAAFVSMATALTASAQISFGGEPLSFSSRSAGTHSFDDAMTIRLTPDFNPEDLIAQSRWQSQRDGRPVRIGQVIPVDVDFASKASHISSIGDVDVYRLQFKLEGAKAITLYYDAFNIPEGGRLYIYTPDHEIVLGAYTNATHRRNGAFATEPVPGSELIMDYEVSRGGTLPDIKISGAGYIFDKVGGRPVTDNHYGIGEDDSDSDCEININCPEGADWQAEKNGVVQMIMVKGQYISMCSGNLLNNTKGDFTPLIISAGHCASITTNFGVTQSELDKWIFTFHYEKRGCSNGTLAIFRGNSIIGASMKAFLPIKGKSDGLLLQLNDEVPLRYRVYYNGWDSTPDIPSSGAGIHHPAGDAMKISILKKTPALNTWISSSGSGGTDDHFYFKYDQGGTEGGSSGSSLFNQNKHVVGTLTGGAGNCGGTEFYGRLNSHWNEYASDGNTSRMDIYLDPQNNGQTTILNGTYRDGYKPLPSVPRLLLQSTGDQVELNWTAVPADQYPSSYQVEYHIFRNGKEIATTKELSYSDAIDESIIGSGIIRYEVSARFIYPSPLDGVESYKDTDKTSADLAIGDIQTKLKPDVTPLPGGGVSLSWKVPFLSQLVSRFGESPNPVFKTFEVPYVSAAAAQTPNPPVGVVIADKFMAGTYPEKAAIAAVYVMPSAPDSTFHLFLKSNTNRRLQKVTTPSDWQAGTWLRINLDKPFPVNNDHMLFAGIRMPNKYKLNRAIRYVRNPDNLFSITGKKISYNNGVSFEGYGIPSLLGYMAIKYLVVNTDAPKIDMSLVQEPYAKGTNVAPFPELVGIYVYKNGTFIGTQDPSVTTYSVSDGTESDEYEIKLVYKGSGISNGVAQIENNNAVVAYPSVVTDRFSIKNAHMVHAAALYSLDGKQVRSWNNLRNGVTFSVQGLTAGTYMLVMQTANGPVSQKIVKQ

SEQ ID NO: 464 - protein, 670 aa, Porphyromonas gingivalis
MKYLIRLFLSLMLLSLWTGCTHEELSICDGENTLVLRVETGKAPNARATEPGQGIYNENKVGSISVLFYLEGQLRWQVKSTDYQIHEGAYIIPVKEQMRPLFNGNNNFSIYVVANLDFNAPATEAALSQFVVEKSIEVSSTTAPADFVMLAHGNKQINMATTEGKLLGDYKLKRVAAKIRMIKPTINVQGYEVVGNIQAKFRNSVTKGFLTTEAQEIPAAASYKTSEYLDIAESAPANSIHFYSYYNKWTLSTPEKRPEFFIMVKFKKTGQPDNTAKPYYYRVPLESQDNQVKSNVLYNLNVKIEILGSLQEPEAVSVNGTLAIEEWILHQDAFNLPATNYLIVEQHEIFMNNVNTYSVKYQTSQKPISISIQSVTFSYVSSDGTQHNDLVASSSDQYPTITSDNTSIIITSKIPVNNVPKKIVFEVTNGVAGLKETVTVLQYPAQFIVNTLGTASAWRPDGSLAPGLNNKAIYHVVVLVPPENLFEDGTQTIIGYPPTETISFHKKENNTYPIVWSDTNTTKQDLETSRMISPSFELASQLGATLPMPYLEYWPGTSYLLDYSGNYNNKRYALFNCAFYWEKRKVNNEEIKFDDWRLPTEAEIKLIDKLQHNEQSAVQAIMTGNYYWDSYSANGSYKMQGGGGQGNSSKAYVRCVRDVKKPIRDKKSGK

SEQ ID NO: 465 - protein, 1282 aa, Porphyromonas gingivalis
MRKILSFLMMCSLHLGLQSQTWHGDPDSVAALPSIGIQESSCTRITFEVVFPGFYSVEKREGNQVFQRISMPGCGSFGNLGEAELPVLKKMIAVPEFSTANVAVKIKETETFDNYNIYPNPTYVVEELPEGGTYLVEAFAINNDYYSQNVSLPSTHYVYSQDGYFRSQRFIEVTLYPFRYNPVRQEILFAKKIEVTITFDNPQPPLQKNTGIFNKVASSAFINYEADGKSAIENDMVFSRGTTTYISGNVASNLPQNCDYLVIYDDMFNVNQQPHDEIKRLCEHRAFYNGFDVAAVSIKDVLNSFPSNATSYINETKLKNFIRSVYNQSNAKRTLDGKLGYVLLIGKPLSKYLADTDNTKVPTSFIHNVSLIPSHPTFGSICASDYFFSCVSPLDTVGDLFIGRFSVTNAHELHNLIEKTINKEISYNPIAHKNILYAEGKGCDAPILRLFLKEIASGYTVNSILKSNQVSAIDSIFDCLNNGSHHFYFNTHGMPTVWGIGQGLDVNTLTARLNNTSSQGLCTSLSCSSAVADSTIRSLGEVLTTYAPNKGFSAFLGGSRATQYAVYLEGPCPPSEFYEYLPYSLYHNLSTVVGEMLLSSIINTNSVDTYSKFNFNLLGDPALNIMAHGMEVSNCITLPNNTIISSPITIKNGGCLKIPEKGVLHFTNNGSIQVMSGGTLEIGNQAKISGETGANPTFITVYGDGLAINKQVEIDNIDRLNLFSTHSVMPKFHFDSVKFNSAPLYTTNCIVEISNCEFTNRSDIISKNCDLSVENSMFSSSGITVFKPMATSSITGLSTKAKITDNTFFATGNFAYHITNTPGLTATSNAAIKLDNIPEYYISGNKIVNCDEALVLNNSGNRTNRLHNITRNVIKNCRIGSTLYNSYGIYNRNKISNNHIGVRLLNNSCFYFDNAPVINEEDKQTFISNRTWQLYSSNGTFPLNFHYNSLQGGDTDTWIYNDTYTNRYIDVSNNHWGNNDLFDPNQVFNTPDLFIWIPFWDGLPNGRSGNSSAEAVEFQTALDCIGNSDYLSAKVALKMMVETYPESDFAIAALKELFRIEKMSGNDYEGLKDYFRSNPTIISSQNLFPTADFLSARCDIVCENYQSAIDWYENRLNSEISYQDSVFAVIDLGDIYWNMQLDSLRGTGIDLNILSCEQRKSLESHQNVKNYLLSTLPESTGTLLPPLECNKSSLDKSKIISISPNPAKAVVTIIYYTDNPSCSVIKIYGINGASADITGLPKHLSEGYYSIQFNTSNFDPGFYLVTLNVDQKIIDTEKLRIK

SEQ ID NO: 466 - protein, 1274 aa, Porphyromonas gingivalis
MMCSLHLGLQSQTWHGDPDSVAALPSIGIQESSCTRITFEVVFPGFYSVEKREGNQVFQRISMPGCGSFGNLGEAELPVLKKMIAVPEFSTANVAVKIKETETFDNYNIYPNPTYVVEELPEGGTYLVEAFAINNDYYSQNVSLPSTHYVYSQDGYFRSQRFIEVTLYPFRYNPVRQEILFAKKIEVTITFDNPQPPLQKNTGIFNKVASSAFINYEADGKSAIENDMVFSRGTTTYISGNVASNLPQNCDYLVIYDDMFNVNQQPHDEIKRLCEHRAFYNGFDVAAVSIKDVLNSFPSNATSYINETKLKNFIRSVYNQSNAKRTLDGKLGYVLLIGKPLSKYLADTDNTKVPTSFIHNVSLIPSHPTFGSICASDYFFSCVSPLDTVGDLFIGRFSVTNAHELHNLIEKTINKEISYNPIAHKNILYAEGKGCDAPILRLFLKEIASGYTVNSILKSNQVSAIDSIFDCLNNGSHHFYFNTHGMPTVWGIGQGLDVNTLTARLNNTSSQGLCTSLSCSSAVADSTIRSLGEVLTTYAPNKGFSAFLGGSRATQYAVYLEGPCPPSEFYEYLPYSLYHNLSTVVGEMLLSSIINTNSVDTYSKFNFNLLGDPALNIMAHGMEVSNCITLPNNTIISSPITIKNGGCLKIPEKGVLHFTNNGSIQVMSGGTLEIGNQAKISGETGANPTFITVYGDGLAINKQVEIDNIDRLNLFSTHSVMPKFHFDSVKFNSAPLYTTNCIVEISNCEFTNRSDIISKNCDLSVENSMFSSSGITVFKPMATSSITGLSTKAKITDNTFFATGNFAYHITNTPGLTATSNAAIKLDNIPEYYISGNKIVNCDEALVLNNSGNRTNRLHNITRNVIKNCRIGSTLYNSYGIYNRNKISNNHIGVRLLNNSCFYFDNAPVINEEDKQTFISNRTWQLYSSNGTFPLNFHYNSLQGGDTDTWIYNDTYTNRYIDVSNNHWGNNDLFDPNQVFNTPDLFIWIPFWDGLPNGRSGNSSAEAVEFQTALDCIGNSDYLSAKVALKMMVETYPESDFAIAALKELFRIEKMSGNDYEGLKDYFRSNPTIISSQNLFPTADFLSARCDIVCENYQSAIDWYENRLNSEISYQDSVFAVIDLGDIYWNMQLDSLRGTGIDLNILSCEQRKSLESHQNVKNYLLSTLPESTGTLLPPLECNKSSLDKSKIISISPNPAKAVVTIIYYTDNPSCSVIKIYGINGASADITGLPKHLSEGYYSIQFNTSNFDPGFYLVTLNVDQKIIDTEKLRIK

SEQ ID NO: 467 - protein, 925 aa, Porphyromonas gingivalis
MAIMMKSIVFRAFLTILLSWAAITNPTAQEISGMNASCLAAPAQPDTILYESFENGPVPNGWLEIDADADGATWGSPSGSFSVPYGHNGLCTYSHIRSGISTAGNYLITPNIEGAKRVKYWVCNQYSTNPEHYAVMVSTTGTAIEDFVLLFDDSITGKPTPLVWRRRIVDLPEGTKYIAWRHYKVTDSHTEFLKLDDVTVYRSIEGPEPATDFTVINIGQNVGRLTWNYPEDYQPEGKGNEELQLSGYNIYANGTLLAQIKDVSILEYVDSTYSLRDNPLQVEYCVTAVYDESIESSTVCGTLHYATDAILYENFENGPVPNGWLVIDADGDGFSWGHYLNAYDAFPGHNGGHCSLSASYVPGIGPVTPDNYLITPKVEGAKRVKYWVSTQDANWAAEHYAVMASTTGTAVGDFVILFEETMTAKPTGAWYERTINLPEGTKYIAWRHYNCTDIYFLKLDDITVFGTPASEPEPVTDFVVSLIENNKGRLKWNYPNGYEPDKTDDKDPLQLAGYNIYANGSLLVHIQDPTVLEYIDETYSSRDDQVEVEYCVTAVYNDNIESQSVCDKLIYDSQSDIILYEGFEAGSIPEGWLLIDADGDNVNWDYYPWTMYGHDSEKCIASPSYLPMIGVLTPDNYLVTPRLEGAKLVKYWVSAQDAVYSAEHYAVMVSTTGTAVEDFVLLFEETMTAKANGAWYERTITLPAGTKYIAWRHYDCTDMFFLLLDDITVYRSTETVPEPVTDFVVSLIENNKGRLKWNYPNGYEPDKTDDKKPLQLTGYNIYANGSLLVHIQDPTVLEYIDETYSSRDGQVEMEYCVTAVYNDNIESQSVCDKLNYTITSLDNIQSDTSLKIYPNPASYVVRIEGLSRSKSTIELYNALGICILREETHSEKTEIDVSRLNDGVYLIKVVGGNKTTTEKVEIKRP

SEQ ID NO: 468 - protein, 922 aa, Porphyromonas gingivalis
MMKSIVFRAFLTILLSWAAITNPTAQEISGMNASCLAAPAQPDTILYESFENGPVPNGWLEIDADADGATWGSPSGSFSVPYGHNGLCTYSHIRSGISTAGNYLITPNIEGAKRVKYWVCNQYSTNPEHYAVMVSTTGTAIEDFVLLFDDSITGKPTPLVWRRRIVDLPEGTKYIAWRHYKVTDSHTEFLKLDDVTVYRSIEGPEPATDFTVINIGQNVGRLTWNYPEDYQPEGKGNEELQLSGYNIYANGTLLAQIKDVSILEYVDSTYSLRDNPLQVEYCVTAVYDESIESSTVCGTLHYATDAILYENFENGPVPNGWLVIDADGDGFSWGHYLNAYDAFPGHNGGHCSLSASYVPGIGPVTPDNYLITPKVEGAKRVKYWVSTQDANWAAEHYAVMASTTGTAVGDFVILFEETMTAKPTGAWYERTINLPEGTKYIAWRHYNCTDIYFLKLDDITVFGTPASEPEPVTDFVVSLIENNKGRLKWNYPNGYEPDKTDDKDPLQLAGYNIYANGSLLVHIQDPTVLEYIDETYSSRDDQVEVEYCVTAVYNDNIESQSVCDKLIYDSQSDIILYEGFEAGSIPEGWLLIDADGDNVNWDYYPWTMYGHDSEKCIASPSYLPMIGVLTPDNYLVTPRLEGAKLVKYWVSAQDAVYSAEHYAVMVSTTGTAVEDFVLLFEETMTAKANGAWYERTITLPAGTKYIAWRHYDCTDMFFLLLDDITVYRSTETVPEPVTDFVVSLIENNKGRLKWNYPNGYEPDKTDDKKPLQLTGYNIYANGSLLVHIQDPTVLEYIDETYSSRDGQVEMEYCVTAVYNDNIESQSVCDKLNYTITSLDNIQSDTSLKIYPNPASYVVRIEGLSRSKSTIELYNALGICILREETHSEKTEIDVSRLNDGVYLIKVVGGNKTTTEKVEIKRP

SEQ ID NO: 469 - protein, 921 aa, Porphyromonas gingivalis
MKSIVFRAFLTILLSWAAITNPTAQEISGMNASCLAAPAQPDTILYESFENGPVPNGWLEIDADADGATWGSPSGSFSVPYGHNGLCTYSHIRSGISTAGNYLITPNIEGAKRVKYWVCNQYSTNPEHYAVMVSTTGTAIEDFVLLFDDSITGKPTPLVWRRRIVDLPEGTKYIAWRHYKVTDSHTEFLKLDDVTVYRSIEGPEPATDFTVINIGQNVGRLTWNYPEDYQPEGKGNEELQLSGYNIYANGTLLAQIKDVSILEYVDSTYSLRDNPLQVEYCVTAVYDESIESSTVCGTLHYATDAILYENFENGPVPNGWLVIDADGDGFSWGHYLNAYDAFPGHNGGHCSLSASYVPGIGPVTPDNYLITPKVEGAKRVKYWVSTQDANWAAEHYAVMASTTGTAVGDFVILFEETMTAKPTGAWYERTINLPEGTKYIAWRHYNCTDIYFLKLDDITVFGTPASEPEPVTDFVVSLIENNKGRLKWNYPNGYEPDKTDDKDPLQLAGYNIYANGSLLVHIQDPTVLEYIDETYSSRDDQVEVEYCVTAVYNDNIESQSVCDKLIYDSQSDIILYEGFEAGSIPEGWLLIDADGDNVNWDYYPWTMYGHDSEKCIASPSYLPMIGVLTPDNYLVTPRLEGAKLVKYWVSAQDAVYSAEHYAVMVSTTGTAVEDFVLLFEETMTAKANGAWYERTITLPAGTKYIAWRHYDCTDMFFLLLDDITVYRSTETVPEPVTDFVVSLIENNKGRLKWNYPNGYEPDKTDDKKPLQLTGYNIYANGSLLVHIQDPTVLEYIDETYSSRDGQVEMEYCVTAVYNDNIESQSVCDKLNYTITSLDNIQSDTSLKIYPNPASYVVRIEGLSRSKSTIELYNALGICILREETHSEKTEIDVSRLNDGVYLIKVVGGNKTTTEKVEIKRP

SEQ ID NO: 470 - protein, 593 aa, Porphyromonas gingivalis
MNSIMKYQLYTAVIMALSVSSVCGQTPRNTETKRPDTLRRELTIVNDQTVEMEHADPLPAAYKAIEPRLKPFRPEYNKRTFGFVPEVSSSGRNNLPNILPTEGHMKHRGYLNIGIGHTLNQRMDAGYRLIDAEQERLNLFLSYRGMKSAFNTGDFDGDRKDRRMMAGVDYEQRRPSFVLATGLYYSNHYFNNYGRGATTNVGSIPQLSTPVTPQMDNGTHNVRVYLGAKNDVIDARIDYRFFRSIPYLGTDPMKALTEHTPELNVTMSNELSDDIKLGVEVRTGGLFFAKNSEMIQTGVLSETDRNLYYVEGAPTIGFVGDSDNMQWNIQAGVGISSHFGAKGRLFFWPKLDASLSIFPSWRVYAKAFGGVIRNGLADVMQEEMPYLMPNTIVLPSRNALTAQLGVKGNIADVVRMEVYGDFSKLTGVPFYTPTLPLYNPSDLYQYNVSFLPIYADGSRWRAGGKLEYSYRDMLRFLVDASYGKWNLDGGLVASMQPDLILKAEVGVHPIAPLDVRLRYTQLNGRYRYSFGSAGSEALGIGNVHLLSADVSYKLKKNLSLYLKIDNMLAETTELIGYYPMQPFHCFAGFSWTF

SEQ ID NO: 471 - protein, 589 aa, Porphyromonas gingivalis
MKYQLYTAVIMALSVSSVCGQTPRNTETKRPDTLRRELTIVNDQTVEMEHADPLPAAYKAIEPRLKPFRPEYNKRTFGFVPEVSSSGRNNLPNILPTEGHMKHRGYLNIGIGHTLNQRMDAGYRLIDAEQERLNLFLSYRGMKSAFNTGDFDGDRKDRRMMAGVDYEQRRPSFVLATGLYYSNHYFNNYGRGATTNVGSIPQLSTPVTPQMDNGTHNVRVYLGAKNDVIDARIDYRFFRSIPYLGTDPMKALTEHTPELNVTMSNELSDDIKLGVEVRTGGLFFAKNSEMIQTGVLSETDRNLYYVEGAPTIGFVGDSDNMQWNIQAGVGISSHFGAKGRLFFWPKLDASLSIFPSWRVYAKAFGGVIRNGLADVMQEEMPYLMPNTIVLPSRNALTAQLGVKGNIADVVRMEVYGDFSKLTGVPFYTPTLPLYNPSDLYQYNVSFLPIYADGSRWRAGGKLEYSYRDMLRFLVDASYGKWNLDGGLVASMQPDLILKAEVGVHPIAPLDVRLRYTQLNGRYRYSFGSAGSEALGIGNVHLLSADVSYKLKKNLSLYLKIDNMLAETTELIGYYPMQPFHCFAGFSWTF

SEQ ID NO: 472 - protein, 346 aa, Porphyromonas gingivalis
MMEKCIFAHYPHNLVFMIRKHFGIILGFLSLVFSAGAQQEKQVFHFLNLPATAQALAAGGKAITIVDDNPGLAFENPALLGYESGGRAFLSYLYYMSGSHMGNACYASSVGERGMWGVGMRFLNYGSMQGYDQNAIATGSFSASDIAVQGFYSHELSNHFRGGVSLKALYSSIETYSSFGLGVDVGISYYDDDKGYSASALFKNVGAQLKGYNEEREPLDWDFQLGFSRSFINAPFRLHITLFNLNPHYFKRLVPRDLSKMQKFLRHFSIGAEFTPSERFWVGLGYTPQIAQDFEVEGGNKWGGLSAGVGFTSGVVRVGVSAATYHPAALSFMCSVGIRLDDKSIF

SEQ ID NO: 473 - protein, 345 aa, Porphyromonas gingivalis
MEKCIFAHYPHNLVFMIRKHFGIILGFLSLVFSAGAQQEKQVFHFLNLPATAQALAAGGKAITIVDDNPGLAFENPALLGYESGGRAFLSYLYYMSGSHMGNACYASSVGERGMWGVGMRFLNYGSMQGYDQNAIATGSFSASDIAVQGFYSHELSNHFRGGVSLKALYSSIETYSSFGLGVDVGISYYDDDKGYSASALFKNVGAQLKGYNEEREPLDWDFQLGFSRSFINAPFRLHITLFNLNPHYFKRLVPRDLSKMQKFLRHFSIGAEFTPSERFWVGLGYTPQIAQDFEVEGGNKWGGLSAGVGFTSGVVRVGVSAATYHPAALSFMCSVGIRLDDKSIF

SEQ ID NO: 474 - protein, 330 aa, Porphyromonas gingivalis
MIRKHFGIILGFLSLVFSAGAQQEKQVFHFLNLPATAQALAAGGKAITIVDDNPGLAFENPALLGYESGGRAFLSYLYYMSGSHMGNACYASSVGERGMWGVGMRFLNYGSMQGYDQNAIATGSFSASDIAVQGFYSHELSNHFRGGVSLKALYSSIETYSSFGLGVDVGISYYDDDKGYSASALFKNVGAQLKGYNEEREPLDWDFQLGFSRSFINAPFRLHITLFNLNPHYFKRLVPRDLSKMQKFLRHFSIGAEFTPSERFWVGLGYTPQIAQDFEVEGGNKWGGLSAGVGFTSGVVRVGVSAATYHPAALSFMCSVGIRLDDKSIF

SEQ ID NO: 475 - protein, 324 aa, Porphyromonas gingivalis
MCLEPIIAPISSELLEQELTADRFLRMTNKAGNEIYVFTAEEAPHCMKEVGRLREEAFRHYGGGTGKAIDIDEFDTMPGSYKQLIVWDPQNKAILGGYRFIYGRDVAFDTDGKPLLATAEMFRFSDAFLHDYLPYTVELGRSFVSLQYQSTRMGTKAIFVLDNLWDGIGALTVVNPEALYFYGKVTMYKDYDRRARNLILYFLRKHFSDPEGLVKPIHPLPIEISAEDEALFSSSDFDTNYKTLNIEVRKLGINIPPLVSAYIALSPEMRVFGTAVNESFGEVEETGIFIAVGKILEEKKQRHIESFILSRNEKKGLDSSNGRS

SEQ ID NO: 476 - protein, 547 aa, Porphyromonas gingivalis
MKTIVRYSRLPVALFFCLLGAVHLSVEAQMLNTPFELSDQIVLSPTERQYREICVQTKEKRGADLFPLSDKLRDSAYVRFGSAYGDIAGDYLPYNGNNYSSLSLESGGRISVRNYGTLQGSASYSRGMHKRIGWNALRNAEAYYPYLVSDSTGGDYHFEDYRLAGYYSFRAGRLPLGIGFSYRGEVAYRLTDPRTTNTTGALELSCATSLTLPRENRLSLSAAYLYHRQHLTQYNWRPGQQDKFFVSYGFGQVDVSNSPIWFGISRMNYVNGWKLSSRLDTRRGDAIGLDYSGYFLDTEERSSINLFALLYNRLRLYGSWHLSDFDFSFSADYALRQGIERIYEDYKPDDNYHIYDLRILAIRRWYMLNEFSAQAQASYRIRTDRGCALRVSAGSDFYGYDETYRKHGHHTMSGMLRPFAGIAYDHAGSKLDFGLSLSAAYRMVLTHSYKIRTIQKEQLDYQLAYLPYAYRNREGVEVRSSLYVSIPMQNTHRLMTELRLYGDLMKRKDGIAYGKTPGVISHILSDPQAERTSGHTIGAICNISYLF

SEQ ID NO: 477 - protein, 750 aa, Porphyromonas gingivalis
MKKLHMIAALAVLPFCLTAQAPVSNSEIDSLSNVQLQTVQVVATRATAKTPVAYTNVRKAELSKSNYGRDIPYLLMLTPSVVATSDAGTGIGYSGFRVRGTDANRINITTNGVPLNDSESQSVFWVNMPDFASSIEDLQVQRGVGTSTNGAGAFGASVNMRTDNLGLAPYGRVDLSGGSFGTFRRSVKLGSGRIGRHWAVDARLSKIGSDGYVDRGSVDLKSYFAQVGYFGSNTALRFITFGGKEVTGIAWNGLSKEDEAKYGRRYNSAGLMYVDAQGVPHYYHNTDNYEQRHYHAIMTHSFSPSVILNLTAHYTAGYGYTDEYRTGRKLKEYALQPYVENSVTVKKTDLIRQKYLDNDFGGLIGSLNWHTGAWDLQFGASGNIYKGDHFGRITYIKKYNQPLAPDFEYYRNRADKREGAAFAKANWQITPELNMYADLQYRTIGYTINGITDEYDEVQGSMQHIDLDKTFRFLNPKAGLTYSFDDAHTAYASVAVAHREPNRTNYTEAGIGQYPTPERLIDYELGYRYASPLLSAGVGLYYMQYKDQLVLDGRLSDVGQMLTSNVPDSYRMGLELTLGWQILPRLLRWDASFTMSRNKIDRYVQYTSVYDADYNWLELKEETLESTDIAYSPNVIAGSMLTLSHAGFEMAWTSRFVSKQYLDNTQRSDRMLSSYWVNDLRLGYVLPVHFVKRVALGVQLNNLFNLMYASNAYIYDAGYVQASGELSAYADLRYYPQAGFNALGSLTIDF

SEQ ID NO: 478 - protein, 494 aa, Porphyromonas gingivalis
MKRRFLSLLLLYILSSISLSAQRFPMVQGIELDTDSLFSLPKRPWRAIGKTIGVNLAVWGFDHFIMNEDFADISWQTIKSNFQTGFGWDNDKFVTNLFAHPYHGSLYFNAARSNGLSFRHSAPFAFFGSLMWELLMENEPPSINDLCATTIGGIALGEMGHRLSDLLIDNRTTGWERMGREVAIALINPMRFLNRLTAGEVTSVGSRSGQIFQSVPINIVVDAGFRFLADKRHARTGATALTLNLRFDYGDPFRSETFSPYDFFQFKAGLSFSESQPLLSQINLIGILSGCQLLAHERTVLVGGLFQHFDYYNSEKRISKNSEEVLVTPYRISQVAALGGGLIFQHHGKFRRRPLELYAETYLNVVPMGASLSDHYNVDNRDYNLGSGLSGKLYLGATYNDLWSWLLGVESYRLYTWIGYEEPHQKNTDVSSFMVQGDESKARLLVTSSEFAFHPGPWHVAIVARRFIRKTAYQFYPNVSFDTGDIQLRVGFHF

SEQ ID NO: 479 - protein, 294 aa, Porphyromonas gingivalis
MKRLIVFLAMGGLLFTLANAQEANTASDTPKKDWTIKGVTGLNASQTSLTNWAAGGENTVAGNLYLNIDANYLKDKWSWDNGLRTDFGLTYTTANKWNKSVDKIELFTKAGYEIGKHWYGSALFTFLSQYAKGYEKPSDHLTGVKHISNFFAPAYLTLGIGADYKPNEKFSLYLSPTTGKLTVVADDYLSSLGAFGVKVGEKTMFELGALVVGSANINLMENVNLITKASFFSAYTHDFGNIDINWEAMLAMKINKFLTATIATNLIYDDDVKINDGPKIQFKEVVGVGVAYTF

SEQ ID NO: 480 - protein, 204 aa, Porphyromonas gingivalis
MKKMILAATMLLATIGFANAQSRPALRLDANFVGSNLMQKVANTSVNNKMIVGLRVGAAAEFALSNDGFYLAPGLAYTMRGAKMESLSETTTRLHYLQIPVNAGMRFSFADNMAISLEAGPYFAYGVAGTIKTKVAGVTASVDAFGDNGYNRFDLGLGLSAALSYDRYYVQIGYEHGLLNMLKDAPDKTSLRNHDFFVGLGVRF

SEQ ID NO: 481 - protein, 243 aa, Porphyromonas gingivalis
MKRIFTVALVLLASVTMAIGQSRPALRVDANFVGSNQSMKRDGYVWDTKMNVGLRVGAAAEFMIGSRGFYLAPGLNYTMKGSKTEWDIPEMVPGTYITMVSTRLHYLQLPINAGMRFDLMNDMAVSIEAGPFLAYGIYGTYRQKLEGWKPNNYSTEFFGPTLGGPTNIRWDIGANIIAAFHYKRYYIQIGYEHGFVDIVSGGGSDIPRLNDNRQSSSTTALREKGNNEYAYNRDFFVGIGYRF

SEQ ID NO: 482 - protein, 207 aa, Porphyromonas gingivalis
MKRMLLLLVVLLYGIAGRLAAQDVIRPWSLQVGAGYSDTENIPGGFTYGFYLGKRMGSFLEVGLSMYNSTRQTANNADSFASNEGDGSFQVNMSSPNEKWSFFDAGSANCYMIVVGVNPLHLFWQNSRHNLFLAVQAGLSNKHNIHFIYGDKGAKVSIYTNSNTYIGYGARVAYEYQIHKNVGAGAAVMYDHGNKMLTAMATLSTHF

SEQ ID NO: 483 - protein, 951 aa, Porphyromonas gingivalis
MRVSDLCSRLSWLLPVILVGLLCATLVAAERPMAGAVGLHHRRHAALSDSTAKDTVPLAKPIPDSAFRDSLPADSTGSMRQDSVYDDEFELEDIVEYEAADSIVLLGQNRAYLFGKSYVSYQKSRLEANFMYLNTDSSTVYTRYVLDTAGYPMAFPVFKDGEQSFEAKNFTYNFRTEKGIISGVITQQGEGYLTAGKTKKMPDNIMFMQGGRYTTCDNHDHPHFYINLSKAKVHPEKDIVTGPVNLVIADMPLPIGLPFGYFPFSNKYSSGILMPTYGEDNRYGFYLRNGGYYFAFSDYIDLALRGEIFSKGSWGISAQSKYKKRYKYNGSFEANYLVSKSGDKYVPGDYSKTTSLNIRWTHSQDPKANPLQTLSANVNFATGSYFQNSLNTTYDVNARTATTRSSAVSYSRKFPGTPFSITGSMDISQNMRDTTVSLTLPNLSINMSTRYPFKRKTRVGPERWYEKLSVGYSGQLRNSILTKEKDLLQSNLVRDWKNGMRHSVPISLTVPLLDYINLTMGVNYNEWWYTKGIRKSWNEDKKTFLPSDTTYKFRRLYDYSLSAGLSTTLYGMFKPWKPFSFGGNLIMIRHRFTPTVSFSYMPDFTKRRYGFWELLEHTDQNGKLHTLLYSPYFEQIFGAPSMGNAGSVNFSFDNNLEAKIKSKSDSTGIKKISLIDQFTWSTSYNMFADSIRWSNISASLALRLSKSFTLRLSGLFDPYLTKYYEGEDGKIIPYKSNDLRIFNGKGLARLISTGTSFSYTLNKESLSGLIALFSGKKERRDEKKNTGATPHEGDDAADILEGGRPQNESGGSLLERNRQGGAVDQDGYFAYSIPWSLSFDYSWNIATDYNRYNVNKMEHYYRVTQNLSFRGNIQPTPNWSFGFNANYNFDLKKITSLTCNVTRDMHCWAISASFIPIGAYKSYNFVISVKSSLLQDLKYQQSNRPITNTWY

SEQ ID NO: 484 - protein, 1226 aa, Porphyromonas gingivalis
  MOD_RES (983)..(983): Xaa can be any naturally occurring amino acid
MMKRYTIILAVFLLFCTVFTFQIKARPYERFADVEKPWIQKHSMDSKLVPANKGNLIQAEIVYQSVSEHSDLVISPVNEIRPANRFPSHRKSFFAENLRASPPVVPVAVDKYAVPVANPMDPENPNAWDVTLKITTKAVTVPVDVVMVIDQSSSMGGQNIARLKSAIASGQRFVKKMLPKGTATEGVRIALVSYDHEPHRLSDFTKDTAFLCQKIRALTPIWGTHTQGGLKMARNIMATSTAVDKHIILMSDGLATEQYPVKNVTTADFIGKTGNANDPIDLVIQGAINFPTNYVSNNPSTPLTPNYPTHSSKVGRRNLPESKFDYSNLSARITFDGVAGALVYEPRFPHPYYYYFPCNAAINEAQFAKNSGYTIHTIGYDLGDFALANNSLKLTATDENHFFTATPANLAAAFDNIAQTINIGIQRGEVTDFVAPGFIVKNLTQSGDVTHLLNVSNGTVHYDVSTKKLTWTTGTILSSSEATITYRIYADLDYIQNNDIPVNTTSAIGPDLGGFDTNTEAKLTYTNSNGEPNQQLIFPRPTVKLGYGVIKRHYVLVNKDGQPIQANGTVVSSLSEAHVLQSQDFFLPSGGGHIVPKWIKLDKTTEALQYYSVPPTNTVITTADGKRYRFVEVPGSTPNPGQIGISWKKPAGNAYFAYKLLNYWMGGTTDQQSEWDVTSNWTGAQVPLTGEDVEFATTENFGSPAVADLHVPTTNPKIIGNLINNSDKDLVVTTSSQLTINGVVEDNNPNVGTIVVKSSKDNPTGTLLFANPGYNQNVGGTVEFYNQGYDCADCGMYRRSWQYFGIPVNESGFPINDVGGNETVNQWVEPFNGDKWRPAPYAPDTELQKFKGYQITNDVQAQPTGVYSFKGMICVCDAFLNLTRTSGVNYSGANLIGNSYTGAIDIKQGIVFPPEVEQTVYLFNTGTRDQWRKLNGSTVSGYRAGQYLSVPKNTAGQDNLPDRIPSMHSFLVKMQNGASCTLXILYDKLLKNTTVNNGNGTQITWRSGNSGSANMPSLVMDVLGNESADRLWIFTDGGLSFGFDNGWDGRKLTEKGLSQLYAMSDIGNDKFQVAGVPELNNLLIGFDADKDGQYTLEFALSDHFAKGAVYLHDLQSGAKHRITNSTSYSFDAKRGDSGARFRLSYGCDENVDDSHVVSTNGREIIILNQDALDCTVTLFTIEGKLLRRLKVLAGHREVMKVQTGGAYIVHLQNAFTNDVHKVLVEY

SEQ ID NO: 485 - protein, 1225 aa, Porphyromonas gingivalis
  MOD_RES (982)..(982): Xaa can be any naturally occurring amino acid
MKRYTIILAVFLLFCTVFTFQIKARPYERFADVEKPWIQKHSMDSKLVPANKGNLIQAEIVYQSVSEHSDLVISPVNEIRPANRFPSHRKSFFAENLRASPPVVPVAVDKYAVPVANPMDPENPNAWDVTLKITTKAVTVPVDVVMVIDQSSSMGGQNIARLKSAIASGQRFVKKMLPKGTATEGVRIALVSYDHEPHRLSDFTKDTAFLCQKIRALTPIWGTHTQGGLKMARNIMATSTAVDKHIILMSDGLATEQYPVKNVTTADFIGKTGNANDPIDLVIQGAINFPTNYVSNNPSTPLTPNYPTHSSKVGRRNLPESKFDYSNLSARITFDGVAGALVYEPRFPHPYYYYFPCNAAINEAQFAKNSGYTIHTIGYDLGDFALANNSLKLTATDENHFFTATPANLAAAFDNIAQTINIGIQRGEVTDFVAPGFIVKNLTQSGDVTHLLNVSNGTVHYDVSTKKLTWTTGTILSSSEATITYRIYADLDYIQNNDIPVNTTSAIGPDLGGFDTNTEAKLTYTNSNGEPNQQLIFPRPTVKLGYGVIKRHYVLVNKDGQPIQANGTVVSSLSEAHVLQSQDFFLPSGGGHIVPKWIKLDKTTEALQYYSVPPTNTVITTADGKRYRFVEVPGSTPNPGQIGISWKKPAGNAYFAYKLLNYWMGGTTDQQSEWDVTSNWTGAQVPLTGEDVEFATTENFGSPAVADLHVPTTNPKIIGNLINNSDKDLVVTTSSQLTINGVVEDNNPNVGTIVVKSSKDNPTGTLLFANPGYNQNVGGTVEFYNQGYDCADCGMYRRSWQYFGIPVNESGFPINDVGGNETVNQWVEPFNGDKWRPAPYAPDTELQKFKGYQITNDVQAQPTGVYSFKGMICVCDAFLNLTRTSGVNYSGANLIGNSYTGAIDIKQGIVFPPEVEQTVYLFNTGTRDQWRKLNGSTVSGYRAGQYLSVPKNTAGQDNLPDRIPSMHSFLVKMQNGASCTLXILYDKLLKNTTVNNGNGTQITWRSGNSGSANMPSLVMDVLGNESADRLWIFTDGGLSFGFDNGWDGRKLTEKGLSQLYAMSDIGNDKFQVAGVPELNNLLIGFDADKDGQYTLEFALSDHFAKGAVYLHDLQSGAKHRITNSTSYSFDAKRGDSGARFRLSYGCDENVDDSHVVSTNGREIIILNQDALDCTVTLFTIEGKLLRRLKVLAGHREVMKVQTGGAYIVHLQNAFTNDVHKVLVEY

SEQ ID NO: 486 - protein, 425 aa, Porphyromonas gingivalis
MEVKKNTVVLRLLIWFVAILLFHSSRLWGQEGEGSARYRFKGFVDTYHAVRSSSPFDFMSSRTRVRGELERSFGNSKVAVSVNATYNALLKDETGLRLREAFFEHQEEHWGLRLGRQIVIWGAADGVRITDLISPMDMTEFLAQDYDDIRMPVNALRFSVFNESMKVEVVVLPVFEGYRLPVDPRNPWNIFSLSPIAQGMNIVWKEEAGKPAFKVANIEYGARWSTTLSGIDFALAALHTWNKMPVIEVQGIVPTEIIVSPRYYRMGFVGGDLSVPVGQFVFRGEAAFNIDKHFTYKSHAEQEGFQTINWLAGADWYAPGEWMISGQFSMESIFRYRDFISQRQHSTLITLNVSKKFFGSTLQLSDFTYYDLTGKGWFSRFAADYALNDQIHLMAGYDWFSSKGSGIFDRYKDNSELWFKARYSF

SEQ ID NO: 487 - protein, 404 aa, Porphyromonas gingivalis
MSSCEVAYFSLKPIDLQNIRERNHSSDIALSNLLDNSNQLLATILIGNNVINVAIVILSNYAIEQTFVFSSPIIGFLIQTILLTTVLLLFGEILPKVYARKNPLQYSRFSAAAMSVIYKILSPFSKLLVKSTGIVTRGISKKKYDMSVDELSKAVALTTTEGEPEEKEMINEIIKFYNKTACEIMVPRIDIVDVDLSWPFRKMLDFVVSSGYSRLPVSEGSEDNIKGVIYIKDLIPHMDKGDEFDWHPLIRKAYFVPENKRIDDLLEEFRANKVHVSIVVDEFGGTCGLITMEDILEEIVGEITDEYDEEELPFKVLGDGSYLFEGKTSLSDVRHYLDLPENAFGELGDEVDTLSGLFLEIKQELPHVGDTAVYEPFRFQVTQMDKRRIIEIKIFPFERTWEVE

SEQ ID NO: 488 - protein, 260 aa, Porphyromonas gingivalis
MKLLLYLLLVLSTLSPMYSQMLFSENLTMNIDSTKTIQGTILPVLDFKTEKENVFTFKNTANLNLLIKHGQVINLINKLEFSTYGNKVTVSGGYVHTEYRYLLHHVFEVYPYVESQWAESRGMKYKVSTGLQSRYRLVNSDNCLMFATLGVFFEFEKWEQPATSLFAGTYAYSRSIKSHLSISFRHRLGEHWEFTTTAIHQGKPDSYFKKARFGGAIDLKYHITPTIGIRGAYRIIYDTAPIVPVRKDYNTVDVGIDISF

SEQ ID NO: 489 - protein, 834 aa, Porphyromonas gingivalis
MKRIVLSSFLFVLSILSLMAQNNTLDVHISGTIKDASSGEPVPYATVSIRLTGADTTQVFRQVTDGNGYFVIGLPAAPSYHLTASFVGMKTHTMQISRGNGQHDIKSIDISLESEDKQLSTVTVSAARPLVKMEIDRLSYNMKDDPAAKTNNLLEMLRNVPLVTVDGQGNIQVKGSSNFKIHLNGRPSTMVSSNPKEVFRSIPAHTIKRVEVITDPGVKYDAEGTSAILDIVTEEGKKLEGYSGSITASVSNNPTANGSIFLTAKSGKVGLTTNYNYYGGKNKGSRYFTERTTSMLQTIEEGKGQETFGGHFGNALLSFEIDSLNLFTVGGNVRLWEMTTDRNSVEKSFAGSNLMSYIDRKLKTQMDAGSYELNADYQHSTRLPGELLTVSYRFTHNPNNSETFIDQWKRDPLNTANTIQYAGQHSKSDAGMDEHTAQVDYTRPLGQAHSLEAGLKYIYRHATSDPLYEIRPSEDAPWQPGSLYAQNPSNGKFRHDQYIGAAYAGYNYRKDQYSLQTGLRVESSRLKALFPENAAADFSHNSFDWVPQLTLGYTPSPMKQLKLAYNFRIQRPAIGQLNPYRLQTNDYQVQYGNPDLKSEKRHHVGLSYNQYGAKVMLTASLDYDFCNNAIQNYTFSDPANPNLFHQTYGNIGREHSFSLNTYAMYTPAVWVRIMLNGNIDRTFQKSEALGIDVNSWSGMVYSGLMFTLPKDWTVNLFGGYYHGGRSYQTKYDGNVFNNIGIAKQLFDKKLRVSLSANNIHAKYSTWKSRTIGNGFTIYSENAGIQRSVSLSLTYSFGKMNTQVRKVERTIVNDDLKQTSSQGQQGGGQGNPTGN

SEQ ID NO: 490 - protein, 399 aa, Porphyromonas gingivalis
MRLSAILIALIVMLPAVLSGQHYYSMAGERLETDSIRPNELSASIRSALFFRNNEYNARSVKGYTLPGARVSAFASYSLPAAHGVKLSLGVSTLNYWGASRYPAGIAYSDLPYWTDYNDYVRLRILPYVQAMLKPTATTALMLGNIAGGTAHGLIEPIYNPELDLTADPEAGVQFRGDWTRFRMDVWVNWMSMIFKNDNHQESFVFGLSTTSKLLSGEGKWRLELPLQAIATHRGGEYNWAQQDTVHTWVNGAVGLKLSYRPRTDKPMQIWGSAYGVAALSSGGYFPYERGWGGYLSLGMDLEHFAFRTDYWYGRHYVSPFAAPFANSLTYDKQPLTNGWGDYIRLYADYSWRMARSVSLAAVARVWFQPSDRFAMSHALELTMRIDPKFPIAFLKGNH

SEQ ID NO: 491 - protein, 382 aa, Porphyromonas gingivalis
MNKSLLSLACLILCGMPAIAQQTGPAERSGEPSLAERVFGLEQKQKKLKVYLGIQSFYDQPLVDDESHIGHFKVQELRMSAHGELNRHLSFDWRQRLNRAADGTSFADNLSNAIDIAGVDWHPNDKVSFFFGRQYARFGGIEYDMNPVEIYQYSDLVDYMTCYTSGVNFAWNFHPEQQLQLQVLNAYNNRFADRYHVTPDVATATSYPLLYSAQWNGTLLGGALHMRYAVSMAHQAQERNMWYFTAGNLFNPGKRINGYLDLTYSIEGLDDKGIMTARYGKGKTLTDVKYYALVSKWNFRIFDQVNLFLKGMYENGYAPAQYGESSHTRHSYGYMGGVEYYPTETNFRLFVTYIGRHYRYSATETESTNALRAGLIYQIPFL

SEQ ID NO: 492 - protein, 222 aa, Porphyromonas gingivalis
  MOD_RES (175)..(175): Xaa can be any naturally occurring amino acid
MKHLFKSTLVLLCALSFSGTYTFAQENNTEKSRFDFSVRLGQGYIAGSTTNLMYGYTSANDRLLSGAIYLGLTPSKKENATGVAFRFLSPSPGYYVDISGKENTLNYAFYVVGAYNRIAIPIRPIKNFNFIFSTEVGMAWMSRHEQIYNSTSQTWDKQRKSRSGLDFGLGMHLQXHINKTVYFMAGTDLTSCMFGKRINDYQQKDRTFIALIDNSIGIGLNL

SEQ ID NO: 493 - protein, 391 aa, Porphyromonas gingivalis
MIIKKMLKNKLAPLAILFLFAPKAMKAQEQLNVVHTSVPSLNISPDARAAGMGDIGVATTPDAYSQYWNPSKYAFMDTKAGISFSYTPWLSKLVNDIALMQMTGFYKLGTDENQAISASLRYFTLGKLETFDELGESMGEAHPNEFAVDLGYSRQLSENFSMAVALRYIRSDQSTHNTGENQAGNAFAADIAGYLQKYVLLGNAESLWSLGFNVKNIGTKISYDGGVTSFFIPTSLNLGTGLLYPIDDYNSINFNLELSKLLVPTPPIMDQNDQAGYEAALKKYQETSSISGIFSSFGDAPGGLKEEFREITWGLGAEYSYDDKFFVRAGYSYLHPTKGNLQYFTAGAGFKMNIFRIDASYLLSTIQSNPLDQTLRFTLAFDMDGLRNLFH

SEQ ID NO: 494 - protein, 446 aa, Porphyromonas gingivalis
MKTTVQQIILCLALMMSGVLGGNAQSFWEEIAPPFISNEPNVKYIIPNMGIDSKGTIYVTVTKRIQQGANYTSEQLGMYYRPLGDNEQWWKHDPYFDDKIVADIQTDAYGRVYVCTTSSRDQEYQLYINEQNEWRCIFKTSVSTYEHGMAVFRSSTGVTYIGTRHHIFASGVNDFEFNTIYEDSTPMSCRFAEATNSGTIYLALMHETTMSTTILTYQNGEFVDISESELSNSIIASMCSNKEGDIIALVTSYTGFMSGTLAIRKADEGKWQLVGGDIQNAIVQNICMMDDNKIACEVFGTPNGVDGRTRVCVSDASVFDFEWYEDEIYGGLIFDTFFYSPWDKLLYAKFGGIMLRSKESFITSFISPTVVQGVDVYTLAGKIRIESETPVSEVLLFDLAGRMVLRQTIDNKIYSDIDTNGLKRSGIYVVSVRLSSGQVFSHKVQV

SEQ ID NO: 495 - protein, 308 aa, Porphyromonas gingivalis
MIIRCLIRRPRTVLFGLIFVVGLFSAMAQEKKDSLSTVQPVPNSSMVEQTPLLSIDHPVLPASFQNTRTLKRFRDKHLSDALLNGLKPHRSSLQLNEELNFAAERRDFVSPLLQTRHAAGVLSWRPTDRMHFYTSGNIGLGHDLLTGVRKDFGWNAGADFLLSQNLTAHVQGGWQQNFGFIPMTAVNGQLRWQATERLSFTTGIDYRQVQWNAFDNRTFSLKGSARYEVMDNVFVNGFGSYPLYSSTRSGLNMAVPMHGFGPQYGGSLELKVSERFGFAVGMEREYNIWTRRWETHYFAYPVFYGDKK

SEQ ID NO: 496 - protein, 315 aa, Porphyromonas gingivalis
MKTNRRYAFVLPLLLLTGLLAWGQDSSHGSNTAFATDSSSRELPTEQSAYRIHSAYMVGGGGSITRDTYLSPLRYGGWTLNLLGEKTFPLKASDSRWMIRTGHELDFALMDNPANNAHFYSLLYNGSAAALYRLGAKHLRAAWMDNLRLAFGPGLEIGLGGIYSTRNGNNPATLKLYTNAIAQASIGYYVPSETFPLYFRLLSQINLFGIAYGNGFGESYYENFLLNNGIAGSLHFTYPGKFTRFTTLITADIPIRNFCTLRVGYRYSHLGSSLNALDTRIHSHTAFIGFVTEFYRFRGRKAMNTGRRTSLYYHD

SEQ ID NO: 497 - protein, 285 aa, Porphyromonas gingivalis
MVVTLLVIVGIVVVVRYSLRVHVHKTGTVVSAAIFGFILLGKTVPCDTRNFFSSESDEPESRVATEIAHLCEIGFQIHASSIHVAVRTDFGQAGIHCPMATDASATEFDRSAECAERTSAQIDTAIRSQSQIIRTHIDTCPKSSGTIGGSTHTSLHLKVFDGRGEVGHIHPKDGLRFGVVEGYSIGSYVDAIGIGATHAKAGISDTRTGIAGGYHGGSQHQQIGDVTTIIGLGKFGLANVGVSDRGFRRGASSYDLYGLELHIAKTIYLAVGDGCLCRQAERQDG

SEQ ID NO: 498 - protein, 599 aa, Porphyromonas gingivalis
MENLKNIQPREDFNWEEFEAGGVHAAVSRQEQEAAYDKTLNTIKEKEVVMGRVTAINKREVVINVGYKSEGVVPATEFRYNPELKVGDEVEVYIENQEDKKGQLVLSHRKGRAARSWERVNEALEKDEIVKGYVKCRTKGGMIVDVFGIEAFLPGSQIDVRPIRDYDAFVEKTMEFKIVKINQEYKNVVVSHKVLIEAELEQQKKEIIGKLEKGQVLEGIVKNITSYGVFIDLGGVDGLIHITDLSWGRVAHPEEIVQLDQKINVVILDFDEDRKRIALGLKQLMPHPWDALDSELKVGDKVKGKVVVMADYGAFVEIAQGVEGLIHVSEMSWTQHLRSAQDFLHVGDEVEAVILTLDREERKMSLGLKQLKPDPWADIETRFPVGSRHHARVRNFTNFGVFVEIEEGVDGLIHISDLSWTKKIKHPSEFTEVGADIEVQVIEIDKENRRLSLGHKQLEENPWDVFETVFTVGSIHEGTVIEVMDKGAVVSLPYGVEGFATPKHMVKEDGSQAVLEEKLPFKVIEFNKDAKRIIVSHSRVFEDEQKMAQREANAERKAEAKAAQKEAAAEAANPAQAVEKATLGDLGELAALKEKLSEN

SEQ ID NO: 499 - protein, 550 aa, Porphyromonas gingivalis
MGRVTAINKREVVINVGYKSEGVVPATEFRYNPELKVGDEVEVYIENQEDKKGQLVLSHRKGRAARSWERVNEALEKDEIVKGYVKCRTKGGMIVDVFGIEAFLPGSQIDVRPIRDYDAFVEKTMEFKIVKINQEYKNVVVSHKVLIEAELEQQKKEIIGKLEKGQVLEGIVKNITSYGVFIDLGGVDGLIHITDLSWGRVAHPEEIVQLDQKINVVILDFDEDRKRIALGLKQLMPHPWDALDSELKVGDKVKGKVVVMADYGAFVEIAQGVEGLIHVSEMSWTQHLRSAQDFLHVGDEVEAVILTLDREERKMSLGLKQLKPDPWADIETRFPVGSRHHARVRNFTNFGVFVEIEEGVDGLIHISDLSWTKKIKHPSEFTEVGADIEVQVIEIDKENRRLSLGHKQLEENPWDVFETVFTVGSIHEGTVIEVMDKGAVVSLPYGVEGFATPKHMVKEDGSQAVLEEKLPFKVIEFNKDAKRIIVSHSRVFEDEQKMAQREANAERKAEAKAAQKEAAAEAANPAQAVEKATLGDLGELAALKEKLSEN

SEQ ID NO: 500 - protein, 458 aa, Porphyromonas gingivalis
MIVDVFGIEAFLPGSQIDVRPIRDYDAFVEKTMEFKIVKINQEYKNVVVSHKVLIEAELEQQKKEIIGKLEKGQVLEGIVKNITSYGVFIDLGGVDGLIHITDLSWGRVAHPEEIVQLDQKINVVILDFDEDRKRIALGLKQLMPHPWDALDSELKVGDKVKGKVVVMADYGAFVEIAQGVEGLIHVSEMSWTQHLRSAQDFLHVGDEVEAVILTLDREERKMSLGLKQLKPDPWADIETRFPVGSRHHARVRNFTNFGVFVEIEEGVDGLIHISDLSWTKKIKHPSEFTEVGADIEVQVIEIDKENRRLSLGHKQLEENPWDVFETVFTVGSIHEGTVIEVMDKGAVVSLPYGVEGFATPKHMVKEDGSQAVLEEKLPFKVIEFNKDAKRIIVSHSRVFEDEQKMAQREANAERKAEAKAAQKEAAAEAANPAQAVEKATLGDLGELAALKEKLSEN

SEQ ID NO: 501 - protein, 426 aa, Porphyromonas gingivalis
MEFKIVKINQEYKNVVVSHKVLIEAELEQQKKEIIGKLEKGQVLEGIVKNITSYGVFIDLGGVDGLIHITDLSWGRVAHPEEIVQLDQKINVVILDFDEDRKRIALGLKQLMPHPWDALDSELKVGDKVKGKVVVMADYGAFVEIAQGVEGLIHVSEMSWTQHLRSAQDFLHVGDEVEAVILTLDREERKMSLGLKQLKPDPWADIETRFPVGSRHHARVRNFTNFGVFVEIEEGVDGLIHISDLSWTKKIKHPSEFTEVGADIEVQVIEIDKENRRLSLGHKQLEENPWDVFETVFTVGSIHEGTVIEVMDKGAVVSLPYGVEGFATPKHMVKEDGSQAVLEEKLPFKVIEFNKDAKRIIVSHSRVFEDEQKMAQREANAERKAEAKAAQKEAAAEAANPAQAVEKATLGDLGELAALKEKLSEN

SEQ ID NO: 502 - protein, 240 aa, Porphyromonas gingivalis
MKKAILSGAALLLGLCANAQNVQLHYDFGHSIYDELDGRPKLTTTVENFTPDKWGSTFFFIDMDYTGKGIQSAYWEISRELKFWQAPVSIHLEYNGGLSTSFTFGHDALIGATYTYNNPSFTRGFTITPMYKHLGAHDFHTYQITGTWYMHFLDGLLTFNGFLDLWGFPQENPIGGPVLKEGDKFVFLSEPQFWINLNRIKGIDKDFNLSIGTEMEISRNFARMDKFSCIPTLAVKWTFN

SEQ ID NO: 503 - protein, 434 aa, Porphyromonas gingivalis
MYKDYKGLYASLRWYALIIGLLFAADGIQAQNNNFTESPYTRFGLGRLGERTTISGHSMGGLGVGLRQGTYVNAVNPASYSAVDSMTFIFDFGASTGITWYAENGKKDNRKMGNIEYFAMLFPISKSIAMSAGVLPYSASGYQFGSVDQVEGGSVQYTRKYLGTGNLNDLYVGIGATPFKNFSIGANASSLFGRFTHSRQVIFSTEAPYNPVHLSTLYLKAAKFDFGMQYHLLLKSDRSLVIGAVYSPRVKMHSELTQIKNQVQNGVVVESETQEYIKGMDYYTLPHTLGIGFSYEKKDKLLLGADVQYSKWKGEKFYKSDCKFQDRIRVSLGGEIIPDINAVGMWPKVRYRFGLHGENSYLKVPTKGGVYQGYHIVGAVFGIGIPLNDRRSFVNVSLEYDRLIPKEGMIKENALKLTFGLTFNESWFKKLKLN

SEQ ID NO: 504 - protein, 926 aa, Porphyromonas gingivalis
MRSIYQLLLSILLASLGFVGLEAQQAGVAGRVLDEEGNPMIQANVQLVQSTGQVAVAAGATNEKGLFSLKTSQEGDYILRVSYVGYTTHDEKISLRNGQTITLKDISMNEDARLLQSVTVQAKAAEVVVRNDTLEFNAGSYTVAQGASIEELIKKLPGAEIGSDGKITINGKDISKILVDGKEFFSKDPQVAIKNLPADMVNKVQVLNKLSELSRMSGFDDGEEETVINLTVKPEKKKGLFGTLQAGYGTDQRYMAGGNVNRFDGNKQWTLIGSANNTNNMGFSEMDSEMGSMTFFSPQGGGRRGFGNSGGVTSSSMLGGNFSVEFSSALNTGGDARYGYNDKAIETTKRVENILAEGNTYMDENILERSFSHNGQARFRMQWKPSERTEVVFEPDLSISKIDGFFNDTYETKDATGISINKGSIHQTTQGNNFRLNGELDISHKLNDEGRTISASVSGGLTDEDGDGIYQAVLQSVETNQKQFNDNSNLQYRLRLSYVEPLGKNYFAQAILNRRFSRRNSDREVYRLGDDGQYSILDSQYGLSYSNEFTQYRIGLNLKKIAKTWDYTVGFNVDPNRTVSYRSVAGVEQDKLAFNRVNLSPMLRINYKPSRTTNLRVDYRGRTTQPSINQIAPVQDITNPLFVTEGNPGLKPSYSNNVMAMFSDFDAKSQRAFNIVFFGNYTFDDIVPNTHYDPSTGIRTTRYENASGTWQANLHGTLSLPLKNRAFSFRMSLFNRLAEGQSFINDDKNKALSFRTRERLTLTYRNNWIDTSIGGNIGFYMANNSLSGQKDSRTYDFGGNYQVALTLPYGFRIDSDVEYNTNSGYSGGFSLDEWLWNASLSYSFLRDKAGTLRVNGYDILGQRSSISRSASAINIEESMSNTIGRYVMVDFIYRFNAFSGGGSRSDHQRGNMNRPGPPFGGGRRPS

SEQ ID NO: 505 - protein, 400 aa, Porphyromonas gingivalis
MVMKLIKRSLLLLGAVLLITLPAYSQNDDIFEDDIYTSRKEIRKQNQVKDWQNQEDGYGDDTEYTVASDRDIDAYNRRDGQSYDGKKLSKDKKRDSTRSSVPGRYSRRLARFYKPNTIVISGADNVYVTDDGEYFVYGDEYYDDASSVNIYINSPWCDPFPYTSWYPSFSGWYNYTWNYPWFYYGSHIGWGGYYPGYNWYWSYYYDPFYNPYGIGMGWGYPYGWGSYYGWGGYPGVIHHYHHYPKKTYSNGQHSGAYYSYGRPNRIKGGTSGAKLGTGRYDRIQNSSSQKNKFGLQSNKPNNNLQNVKSGRTGRANRDRNIETVTPNNGQKQNRPVFQQNQSGNDRPTGRNIRSERQGENNDRTFSTPSRSNSNGGFSTPSRSSSGSMSGGGGRSGRGRN

SEQ ID NO: 506 - protein, 398 aa, Porphyromonas gingivalis
MKLIKRSLLLLGAVLLITLPAYSQNDDIFEDDIYTSRKEIRKQNQVKDWQNQEDGYGDDTEYTVASDRDIDAYNRRDGQSYDGKKLSKDKKRDSTRSSVPGRYSRRLARFYKPNTIVISGADNVYVTDDGEYFVYGDEYYDDASSVNIYINSPWCDPFPYTSWYPSFSGWYNYTWNYPWFYYGSHIGWGGYYPGYNWYWSYYYDPFYNPYGIGMGWGYPYGWGSYYGWGGYPGVIHHYHHYPKKTYSNGQHSGAYYSYGRPNRIKGGTSGAKLGTGRYDRIQNSSSQKNKFGLQSNKPNNNLQNVKSGRTGRANRDRNIETVTPNNGQKQNRPVFQQNQSGNDRPTGRNIRSERQGENNDRTFSTPSRSNSNGGFSTPSRSSSGSMSGGGGRSGRGRN

SEQ ID NO: 507 - protein, 581 aa, Porphyromonas gingivalis
MIRKLILLLALMPVASVAFAVPTDSTESKDNRILTSMQSSSLNRDDAPDKWQPMHANFSIQSDMLLSTAQKSKNTWFGNSYIMGIIKNNYLEFGARFEDLYKPLPGHEPEMGRGVPHMYVKGSYHWAELTMGDFYDQFGSGMVFRTYEERNLGIDNAVRGGRIVLTPFDGVRVKGIAGQQRNYFDRTGKVFNSGRGYLLGSDLELNVERWSSAMRDNDYHLAIGGSFVSKHEADEDIFVGVGEDRKRLNLPLNVPIMGLRTNFQKGGLALYAEYGYKYNDPSADNDYIYHDGQAALLSASYSKKGMSILLQAKRCENFAFRSKRSAQLTPLMINYMPAFTQAHTYTLAAIYPYATQPQGEWAFQGELRYNFARRTALGGRYGTGLRINVSHVRGLDKKMLKENPDELIGTDGYTVSFFGMGDLYYSDIDVEITKKVSPGFNFTLTYLNQIYNNKVLHGAAGEKPEKIYANIFVYDGKYKLSNKVALRTELQYLHTKQDQGDWIYGMAELSILPSLMLSLSEQYNIGETKKHYVMGSVTYTHGAHRVAFSAGKTRAGMNCSGGVCRVVPETQGFYLSYSTNL

SEQ ID NO: 508 - protein, 239 aa, Porphyromonas gingivalis
MRSLFLSALRSSSLHGSERRSRISSSVVMSIRQKIRLFHLSVCAQTHDHLIEIHLVCIEFGAIDTDEFRLSSHAYTTSPTHTGAIHHNCIERSYGRYLVTFGQERNELHHHSRPDRNAEVYRFPFDNAFHSIRYEAFRPIRPIVCHDDHFIAIGSHLFFKDNQIFSSGSQYDNYTVACFVESLHDREQRSHTHTASGTNHCADLFDMRTLSQRTYHIRDIVADFEFGQFLGRFAHGLNH

SEQ ID NO: 509 - protein, 211 aa, Porphyromonas gingivalis
MSIRQKIRLFHLSVCAQTHDHLIEIHLVCIEFGAIDTDEFRLSSHAYTTSPTHTGAIHHNCIERSYGRYLVTFGQERNELHHHSRPDRNAEVYRFPFDNAFHSIRYEAFRPIRPIVCHDDHFIAIGSHLFFKDNQIFSSGSQYDNYTVACFVESLHDREQRSHTHTASGTNHCADLFDMRTLSQRTYHIRDIVADFEFGQFLGRFAHGLNH

SEQ ID NO: 510 - protein, 781 aa, Porphyromonas gingivalis
MDRPKPSYIVRIAAILCLFVGRPLFAQSYVDYVDPLIGTLSSFELSAGNTYPVIGLPWGMNSWTPMTGVPGDGWQYTYSAHKIRGFKQTHQPSPWINDYGQFSLLPLTAPQKPSSNDSIALTKWCKQLFSDEQTSWFSHKAETATPYYYSVYLADYDTRVEMAPTERAAIFRIRYSGNTESGSGRWLRLDAFTGGSEISIVDPHTVVGISRKNSGGVPANFACYFILQSDTPMADVLLETDTGKSDEGTRAWAACRFDSQEVTVRVASSFISVEQAERNLAEVKGQSFDRIRLAGREAWNKVLGRIHVEGGTKDERTTFYSALYRCLLFPRRFYEEDASGNFVHYSPYNGEVLPGYLYTDTGFWDTFRALFPLLNLLYPDENIKIQEGLLNVYRESGFFPEWASPGHRDCMIGNNSASVLADAYLKGVRVEDTRTLMNGLLHATKAVHPKISSTGRKGWEWYNSLGYVPADAGIDESAARTLEYAYNDWCILRLGRTLGWDRAALDTLAHRSMNYRHLFDPETKLMRGRNQDGSFRTPFSPFKWGDVFTEGNAWHYTWSVFHDVQGLIDLMGGDRPFVSMLDSVFNTPPMFDESYYGFVIHEIREMQIADMGNYAHGNQPIQHMIYLYNHAGHPWKAQERLREVMGRLYRPTPDGYCGDEDNGQTSAWYVFSALGFYPVTPATDQYVLGSPIFSKVILSFPDGHKTVLHAPANSADTPYIRSISVEGKEWSCNYLTHEQLRSSASIQWMMDTKPNYNRGMKESDRPYSFSTEQQRRANHSN

SEQ ID NO: 511 - protein, 271 aa, Porphyromonas gingivalis
MMKSMRSVLLLLFPLSLITALGCSNNKAAESKSVSFDSAYLERYIPLRADIDTPSLHVMISYVYPSGDDMLTEIFNGLLFGDSLMDSSSPENAMEGYAQMLGEDYRSNNAEANLQGLPSDLLDYIYKQENTIAYCDTGLISTRINTYTYEGGAHTENTVRFANILRTTGKVLEERDIFKIDYAERLSALIIGQLVHDFGKTTPAELDAIGFFNAEEIQPNGNFMIDDKGLTYCFNEYQIAAYARGAVYVRLGYDVLAPLLRDDSPLKRYLP

SEQ ID NO: 512 - protein, 270 aa, Porphyromonas gingivalis
MKSMRSVLLLLFPLSLITALGCSNNKAAESKSVSFDSAYLERYIPLRADIDTPSLHVMISYVYPSGDDMLTEIFNGLLFGDSLMDSSSPENAMEGYAQMLGEDYRSNNAEANLQGLPSDLLDYIYKQENTIAYCDTGLISTRINTYTYEGGAHTENTVRFANILRTTGKVLEERDIFKIDYAERLSALIIGQLVHDFGKTTPAELDAIGFFNAEEIQPNGNFMIDDKGLTYCFNEYQIAAYARGAVYVRLGYDVLAPLLRDDSPLKRYLP

SEQ ID NO: 513 - protein, 267 aa, Porphyromonas gingivalis
MRSVLLLLFPLSLITALGCSNNKAAESKSVSFDSAYLERYIPLRADIDTPSLHVMISYVYPSGDDMLTEIFNGLLFGDSLMDSSSPENAMEGYAQMLGEDYRSNNAEANLQGLPSDLLDYIYKQENTIAYCDTGLISTRINTYTYEGGAHTENTVRFANILRTTGKVLEERDIFKIDYAERLSALIIGQLVHDFGKTTPAELDAIGFFNAEEIQPNGNFMIDDKGLTYCFNEYQIAAYARGAVYVRLGYDVLAPLLRDDSPLKRYLP

SEQ ID NO: 514 - protein, 259 aa, Porphyromonas gingivalis
MKKTTLTGSICALLLFLGLSANAQSKLKIKSIEAATTFSSATAGNGFGGNIFGMDMSIRMRVHHSILPEGLDFSVGIHERRAHWEEAGSPKLMYTNVPSIIGIVEKVIVFEDAEDFFDKKALGRFLISLGISYTKHLGAYWGWTNDAHILFSPIPKSKVHYDTYTRAGSDLVLQSEDVATVSNGFSPGIGLKSSIWWKMPIKSKYDFRLGFSLGYEYLNLLYPYRNFKLDGNKPLSALSPRMNHIGHVGFNFTVGLWTN

SEQ ID NO: 515 - protein, 1266 aa, Porphyromonas gingivalis
MGKYKRAKYRYWLFPFCSDYYTFEGVTFLCASDDMTTKKPQAILDLEKAYNIEIPDLSSQEGISWSVNRYFKQDSSGAVVELCLRECQIESMTWLIDFPALKKLDLSYNQISKLEGLERLTSLTKLRLRSNQIRKLEGLDSLTSLTKLSLSDNQISKLEGLERLTSLAELYLLDNQISKLEGLERLTSLATLELSGNQIRKLEGLERLTSLATLELSGNQIRKLEGLERLTSLTKLRLRSNQISKLEGLERLTSLATLELSGNQIRKLEGLERLTSLATLELSGNQISKLEGLERLSSLTKLRLRSNQISKLEGLERLTSLTKLSLSDNQISKLEGLERLTSLAELYLLDNQIRKLEGLERLTSLTKLRLRSNQISKLEGLDSLTSLTKLSLSDNQISKLEGLERLTSLAELYLLDNQIRKLEGLDGLASLTRLSLRRNQISKLEGLDRLKVLRKLDVSGNDIQSIDDIKLLAPILEQTLEKLRIHDNPFVASSGLILSPYDNHLPEIKALLEKEKEKQKKTSVEYHPFCKVMLLGNHSSGKTTFLSQYDTNYTYQKNTHVLSIHRSNNPNAIFYDFGGQDYYHGIYQAFFTTQSLYLLFWDAKKDRNFVSVDDKEYQTLNFNRPYWLGQIAYACNRCMSVGGNPDGKDTPQTTDDTIIIQTHADETGAKQQTLGCAAENGVLEEIYVSLEPKANSAVHALNYLNERVREVVASRSKSIQITEKDKGLYEALPTIAGDNKHIPISLEALAAQLNKGRAENDLYTIEYLQTELNQLSLRGEVLYYRENEKLNNYVWLDPAAFVQMIHGEILQKDNINRGTVPKDIFECKLHNLSSGSIFEEDGQNGNMILQLLLEELIVYEDKDCYVIPGYLPLHSDDEAYKWLTLGFERPNFVLKFERFIPFGLINQIIAYYGREEGALKRYWRDQVIFTAGREMDRQTLEQEEEKEGLPKTNAEDYQIWIKLDFTDLAISVFIKEQRKTSAKDMQRKEATILSDMLDMYWNNIPPREQIGDKDTEQTRSTIRETNRKKRPIQDLYLSCAQADKDLTESHYIHLGTLDDESKTTARIAAYPLKNGVIDKERVREVSTRPYKHLSVNKNLATAKQIFISYSKEDQTELETCLQFFKPLEKNGQIEIYYDKLTKFETPIHPEIRKRIVEADCIIALISQRYLATDYILDHELPVFREYNKTIVPILIKPCTFEDDEFLREKYFAQKAQIINLGKEGKTIKAYDSITASAHRDENWVAVVREFKEKILRITKQEVNTDE

SEQ ID NO: 516 - protein, 1232 aa, Porphyromonas gingivalis
MTTKKPQAILDLEKAYNIEIPDLSSQEGISWSVNRYFKQDSSGAVVELCLRECQIESMTWLIDFPALKKLDLSYNQISKLEGLERLTSLTKLRLRSNQIRKLEGLDSLTSLTKLSLSDNQISKLEGLERLTSLAELYLLDNQISKLEGLERLTSLATLELSGNQIRKLEGLERLTSLATLELSGNQIRKLEGLERLTSLTKLRLRSNQISKLEGLERLTSLATLELSGNQIRKLEGLERLTSLATLELSGNQISKLEGLERLSSLTKLRLRSNQISKLEGLERLTSLTKLSLSDNQISKLEGLERLTSLAELYLLDNQIRKLEGLERLTSLTKLRLRSNQISKLEGLDSLTSLTKLSLSDNQISKLEGLERLTSLAELYLLDNQIRKLEGLDGLASLTRLSLRRNQISKLEGLDRLKVLRKLDVSGNDIQSIDDIKLLAPILEQTLEKLRIHDNPFVASSGLILSPYDNHLPEIKALLEKEKEKQKKTSVEYHPFCKVMLLGNHSSGKTTFLSQYDTNYTYQKNTHVLSIHRSNNPNAIFYDFGGQDYYHGIYQAFFTTQSLYLLFWDAKKDRNFVSVDDKEYQTLNFNRPYWLGQIAYACNRCMSVGGNPDGKDTPQTTDDTIIIQTHADETGAKQQTLGCAAENGVLEEIYVSLEPKANSAVHALNYLNERVREVVASRSKSIQITEKDKGLYEALPTIAGDNKHIPISLEALAAQLNKGRAENDLYTIEYLQTELNQLSLRGEVLYYRENEKLNNYVWLDPAAFVQMIHGEILQKDNINRGTVPKDIFECKLHNLSSGSIFEEDGQNGNMILQLLLEELIVYEDKDCYVIPGYLPLHSDDEAYKWLTLGFERPNFVLKFERFIPFGLINQIIAYYGREEGALKRYWRDQVIFTAGREMDRQTLEQEEEKEGLPKTNAEDYQIWIKLDFTDLAISVFIKEQRKTSAKDMQRKEATILSDMLDMYWNNIPPREQIGDKDTEQTRSTIRETNRKKRPIQDLYLSCAQADKDLTESHYIHLGTLDDESKTTARIAAYPLKNGVIDKERVREVSTRPYKHLSVNKNLATAKQIFISYSKEDQTELETCLQFFKPLEKNGQIEIYYDKLTKFETPIHPEIRKRIVEADCIIALISQRYLATDYILDHELPVFREYNKTIVPILIKPCTFEDDEFLREKYFAQKAQIINLGKEGKTIKAYDSITASAHRDENWVAVVREFKEKILRITKQEVNTDE

SEQ ID NO: 517 - protein, 1175 aa, Porphyromonas gingivalis
MTWLIDFPALKKLDLSYNQISKLEGLERLTSLTKLRLRSNQIRKLEGLDSLTSLTKLSLSDNQISKLEGLERLTSLAELYLLDNQISKLEGLERLTSLATLELSGNQIRKLEGLERLTSLATLELSGNQIRKLEGLERLTSLTKLRLRSNQISKLEGLERLTSLATLELSGNQIRKLEGLERLTSLATLELSGNQISKLEGLERLSSLTKLRLRSNQISKLEGLERLTSLTKLSLSDNQISKLEGLERLTSLAELYLLDNQIRKLEGLERLTSLTKLRLRSNQISKLEGLDSLTSLTKLSLSDNQISKLEGLERLTSLAELYLLDNQIRKLEGLDGLASLTRLSLRRNQISKLEGLDRLKVLRKLDVSGNDIQSIDDIKLLAPILEQTLEKLRIHDNPFVASSGLILSPYDNHLPEIKALLEKEKEKQKKTSVEYHPFCKVMLLGNHSSGKTTFLSQYDTNYTYQKNTHVLSIHRSNNPNAIFYDFGGQDYYHGIYQAFFTTQSLYLLFWDAKKDRNFVSVDDKEYQTLNFNRPYWLGQIAYACNRCMSVGGNPDGKDTPQTTDDTIIIQTHADETGAKQQTLGCAAENGVLEEIYVSLEPKANSAVHALNYLNERVREVVASRSKSIQITEKDKGLYEALPTIAGDNKHIPISLEALAAQLNKGRAENDLYTIEYLQTELNQLSLRGEVLYYRENEKLNNYVWLDPAAFVQMIHGEILQKDNINRGTVPKDIFECKLHNLSSGSIFEEDGQNGNMILQLLLEELIVYEDKDCYVIPGYLPLHSDDEAYKWLTLGFERPNFVLKFERFIPFGLINQIIAYYGREEGALKRYWRDQVIFTAGREMDRQTLEQEEEKEGLPKTNAEDYQIWIKLDFTDLAISVFIKEQRKTSAKDMQRKEATILSDMLDMYWNNIPPREQIGDKDTEQTRSTIRETNRKKRPIQDLYLSCAQADKDLTESHYIHLGTLDDESKTTARIAAYPLKNGVIDKERVREVSTRPYKHLSVNKNLATAKQIFISYSKEDQTELETCLQFFKPLEKNGQIEIYYDKLTKFETPIHPEIRKRIVEADCIIALISQRYLATDYILDHELPVFREYNKTIVPILIKPCTFEDDEFLREKYFAQKAQIINLGKEGKTIKAYDSITASAHRDENWVAVVREFKEKILRITKQEVNTDE

SEQ ID NO: 518 - protein, 229 aa, Porphyromonas gingivalis
MMKKAFVFVLLVCLFSSFSSSAQTTTNSSRSYFTGRIEKVSLNLGVPPVSTEVWGMTHDANGLPFEIPISFSRFNSQGDIATTYYIANSEATLNEWCDYAHPGGIVRVEGRFWKMTYNIPTYNAVCTRITFENQEIEGTIVLIPKPKVSLPHVSESVPCIRTEAGREFILCEEDDTFVSHDGNEVTIGGKPFLLNTNVKIVGDVSQKYAVGVGEIRFLQICAQTVSQQK

SEQ ID NO: 519 - protein, 228 aa, Porphyromonas gingivalis
MKKAFVFVLLVCLFSSFSSSAQTTTNSSRSYFTGRIEKVSLNLGVPPVSTEVWGMTHDANGLPFEIPISFSRFNSQGDIATTYYIANSEATLNEWCDYAHPGGIVRVEGRFWKMTYNIPTYNAVCTRITFENQEIEGTIVLIPKPKVSLPHVSESVPCIRTEAGREFILCEEDDTFVSHDGNEVTIGGKPFLLNTNVKIVGDVSQKYAVGVGEIRFLQICAQTVSQQK

SEQ ID NO: 520 - protein, 540 aa, Porphyromonas gingivalis
MKTKVLRKFVVAAFAVATLCPLAQAQTMGGDDVKVVQYNQEKLVQTRMSVADNGWIYVMTHSGYDTGNSNVKIFRSKDQGATYQKLRDWDPSDDYQFQDFDIVVTGKNESDIKIWSVELMNKPGGYKSRVAVFSRDANAQNAKLVYKEDFSNVQLYDVDIASNYRSPSSLNNGGNPFALAFAYTGFNNTHKISFVDYVFSLNGGQNFNKNLLFSQDGEKKIDKVDLSLGSTSESMGHNAWPLMGVVFEMNKQGGKSDIGFLSNFVDNDPEFQWSGPIKVSESDMSFSPKIQMLLDEDNNTINGESCHNFMITYSDYDSEYSDWDIRYVYPKKSFKYEKGKTPTMDDLVEAFLTASYQSETNSGLGYDKNANHYLITYAKKEENGTNTLKYRWANYDKIHNKDLWSDTFTYTSSANALYTPQVDINPTKGLVCWSWVEYLPGKRIVWSDTQWTHANGVEDIVMQEGSMKLYPNPAQEYAVISLPTAANCKAVVYDMQGRVVAEASFSGNEYRLNVQHLAKGTYILKVVSDTERFVEKLIVE

SEQ ID NO: 521 - protein, 771 aa, Porphyromonas gingivalis
MLTIRNFLLFCCLSLIAFAADAQSSVSSGRRLTEYVNPFIGTANYGTTNPGAVLPNGLMSVTPFNVSGSTENRFDKDSRWWSAPYSADNSYCIGFSHVNLSGVGCPELSGILLMATSGTFDPDYCCYGSSLSREYARPGEYKAVLDKYGIDAAVTVTERTALTEFAFPEGEGHILLNLGQALSNESGASVRFLNDSTVVGSRLMGTFCYNPQAVFRQYFVLQVSRRPISAGYWKKQPPMTVEAQWDSTAGKYKQYDGYKREMSGDDIGVRFSFNCDQGEKIYVRSAVSFVSEANALYNLEAEQEEVFKSVGGNPAKAFSAIRSRAIERWEEALGTVEVEGGTPDEKTIFYTALYHLLIHPNILQDANGEYPMMGSGKTGNTAHDRYTVFSLWDTYRNVHPLLCLLYPEKQLDMVRTLIDMYRESGWLPRWELYGQETLTMEGDPSLIVINDTWQRGLRAFDTATAYEAMKKNASSAGATHPIRPDNDDYLTLGFVPLREQYDNSVSHALEYYLADWNLSRFAHALGHKEDAALFGKRSLGYRHYYNKEYGMLCPLLPDGSFLTPFDPKQGENFEPNPGFHEGSAYNYAFFVPHDIQGLARLMGGAKVFSERLQKVFDEGYYDPTNEPDIAYPYLFSYFPKEAWRTQKLTRELIDKHFCNAPNGLPGNDDAGTMSAWLVYSMLGFYPDCPGSPTYTLTSPVFPRVRIRLNPQYYPQGELIITTNTENQPTDSIYIHTVSLGNKTLPHGTRHISHADLVRCGHLRYELSNRPR

SEQ ID NO: 522 - protein, 776 aa, Porphyromonas gingivalis
MCKIRFSLLQALVVCLLFTSFSLQAQEEGIWNTLLAIHKTEKAVETPKKVFAVANGVLYSVGKEAPHEAKIFDRISGLSDTSVSSIAYSEQLKSLVIYYASGNIDILDEAGRVTNVPALKDNIDLIDKTLNRLLIVGNRAYLAGGFGLSVLDVAEARIPATYAKGTKVTDVAKLDNDRLLMLKEGQLFIGKETDNLQDPAAWTALSLNLPMGSVTGLGIVGEDICFLLADGRVYVAANQSFEPELLLSSSADSRLYVTDRGLFICAENRIYFIEKGRKTTQFPIADVLGVGAMNESNTAYIALGEEGLASLLLAEGSTAEAMPVAFDGPGDNDFYEMRFSHGRLYAASGLWGTNLMGHAGMVKLYDGNRWTNFDKKTVQEQLGGGFSFNDAIDIAVSNGDPDHFFVGTWGNGLFEFKDGKAIARYSGNETAIAECNPGDARVKAIAFDNKGNLWGTLGAVGKNIFMYDPQSSTWHSFSYPDVANLASFGNMIILPNGDKWVNILHRSGGSTRKGVLIFNDRGTPETTSDDSHLYVEQFVNRLGAAIGHKTIYAMAVDHNGSVWMGSDIGIFGVYNAAGVLSSTSTPIAVRPVGGEEPNLYYVLDKVTVTDIVVDKLNHKWVATQGTGLYLLSEDCSKILAQFTVENSPLLSNNILSLALNDDNGLLYIGTADGLMTFQTGTGSGSASELDGVYVYPNPLRPEYPDGVTIAGLQAGCSVKITDTTGRLLYQTESVTTEVKWNARGADGNRVASGVYAVAVYDPVSKKSKLIRFAVIR

SEQ ID NO: 523 - protein, 1158 aa, Porphyromonas gingivalis
MKRILPIVAFLSLFLALALPAKAQRAMGKTADRSLMASGHWVKIRVDASGVYRLTDEQLRANGFSDPSKVGVFGYGGGVLPEDLSRITTDDLPPVPVLRQGNALYFYAVGPVTWFYNPAKTTMEHTVNTYSTHGYYFLSDAAGAPLQMSQYTGGGASAEALIDYYDELMLHEQELYSPKESGRDLYGESFSAVNTRTVKFPLRGNTRSSGELGTVFSYIAKARSAGGGREMSLSANGILIFSDPFSMTSNEVSNSYLAGKKRRLYHSTPMNSLVNELRLDANYSMTGDAVNLDFIEVATQNDLRYDGAPMHIRRFSNLPVLGGESCRFVISEVPESLVVLQANSSLTASLVPVKTVGDKTIEFVAPPKGQDRRTINTFYAVDLSQASAPEILGAVPNQNLHGEEIPDLIIVSTQALLLEADRLATYRREKNGLKVLVVLQEQVFNEFSGGTPDATAYRLFAKMFYDRWKANAPVGETFPMQMLLFGDGAHDNRKVSVAWQKPYLQQTEFLLTFQAVNSTNVNSYVTDDYFGLLDDQPASVNIGWRNYNMAVGRFPVRTPAEARIAVDKTIRYEEDRESGAWRIRACFAADNGDKHATETSRLIDTVKRYAPAIMPVRAFQDVYPHVIENGLHSIPGAKKKMLETLQSGIILLNYAGHGGPAGWSDEHLLTLNDIHKFNYKHMPIWITATCDFANYDSQTTSAGEEVFLHEKSGTPIMFSTTRVVYNTQNEKINGFMLRRMFEKAKDGRYRTMGEIIRSAKQGMLSTVFPDSINQLSFFLMGDPSVRMNLPTHKVQLTAINGQDPEGQYGTIMLKSLERVALKGKVTDEKGTFDETFSGKVFLTVFDGRKKMTALEEEGNDLSLVYYDYPNVMYAGIAEVKDGLFETSFIVPKDVNYSEHEGRINLYAYNESTKAEAMGVDFSIRVQPGIPDEVTEDNTPPEIISCFLNDSTFRSGDEVNPTPLFMAEVFDLNGINITGSGVGHDITLCIDGRADLTYNLNAYFTSSATDAGVGTILFMIPALAEGDHTARLTVWDIFNNAVHHDFSFRVVDGIAPDVADVILFPNPVRESATFRIFHNRPGSDLNVAVEIYDFTGRLVNSLPVKTYSSSYGEPIEIKWDLTSKYGVKIGNGFYLYRCVVNSPGGQTASMAKKMIVVGQ

SEQ ID NO: 524 - protein, 961 aa, Porphyromonas gingivalis
MKKLFPLLLLILSILVGCGKKEKHSVTEIAREKKRITALLYEKELPTDSVKQLYENSVQNKNLVGQMLFAIEVGKRMRNMSQYTDAMLYHQKGLNAALNLRDTIVAAQAWNHLGTDSRRIGALAEASDYHYKALSLIESFSGNQNRPAIKARSAALNGIGNINLELGYHDEAEKNFLKALQGEKELDSPLGQAINYANLGRIYRQRKEYDKARTYFLLSLEQNNMAENLMGIGLCSINLGEVDEEKGDYQKALQEYATAYKLMEQLSDRWHWLNSCIPMARINLKQGNERLYQHFISLAEGTAKEINSTSHLIEIYNLQYENLERKKEYKQALEAFCLSKTLSDSMSIAHKVSSIQETRFNYERNKSQKELEEIQQVSKAKQEKSKFILLSTLFALFISILLISVLTYAYRQGKKHNKLIKETDKLRSGFFTGITHEFRTPITVIQGLNEKMSSSPDLQASDRTELHKIIDRQSSHMLNLVNQLLDICKIRSGVSTPEWRNGDIVSFVQILIDSFAPYAQAQDITLELQPESKPIVVDFVPSYLQKIISNLLSNAIKYSLAGGRVVISLAKTKNEKNLIIRVADNGIGIDKTDQAHIFDIFYRGQSATEKHGSGVGLSFTNILVENLRGTIKVESQPGKGSAFTISIPTQNQSSSAEILPWLPSSDDIVMPVHIAPDDSPTSPMVAALNHRFEDERPTILLVEDNKDINLLVKLLLCDRYNVLSAANGKEGIALATEHIPDIIITDIMMPIMDGIEMTIRMKQSPLLCHIPIVALTAKSTEQDRLEGIKSGVVSYLCKPFSPEELLMRIEQLLKDRELLKKFYMQKLMLDRKPEEEPQPIDDSSMQFLLAAKDAVSGGIKQNPDFSAQDLAEKMCMSPSQLNRKLTSVVGCSTIGYIQQIKIKLACKLLADESKNISDISIEAGFSDPAYFSRTFKRYMNCSPSQYRQKLLAMPGSDKETV

SEQ ID NO: 525 - protein, 556 aa, Porphyromonas gingivalis
MKKLLQAKALILALGLFQLPAIAQTQMQADRTNGQFATEEMQRAFQETNPPAGPVRAIAEYERSAAVLVRYPFGIPMELIKELAKNDKVITIVASESQKNTVITQYTQSGVNLSNCDFIIAKTDSYWTRDYTGWFAMYDTNKVGLVDFIYNRPRPNDDEFPKYEAQYLGIEMFGMKLKQTGGNYMTDGYGSAVQSHIAYTENSSLSQAQVNQKMKDYLGITHHDVVQDPNGEYINHVDCWGKYLAPNKILIRKVPDNHPQHQALEDMAAYFAAQTCAWGTKYEVYRALATNEQPYTNSLILNNRVFVPVNGPASVDNDALNVYKTAMPGYEIIGVKGASGTPWLGTDALHCRTHEVADKGYLYIKHYPILGEQAGPDYKIEADVVSCANATISPVQCYYRINGSGSFKAADMTMESTGHYTYSFTGLNKNDKVEYYISAADNSGRKETYPFIGEPDPFKFTCMNETNTCTVTGAAKALRAWFNAGRSELAVSVSLNIAGTYRIKLYNTAGEEVAAMTKELVAGTSVFSMDVYSQAPGTYVLVVEGNGIRETMKILK

SEQ ID NO: 526 - protein, 428 aa, Porphyromonas gingivalis
MKLSSKKILAIIALLTMGHAVQAQFVPAPTTGIRMSVTTTKAVGEKIELLVHSIEKKGIWIDLNGDATYQQGEEITVFDEAYHEYTIGTQTLTIYGNTTRLGCRSTGATAVDVTKNPNLTYLACPKNNLKSLDLTQNPKLLRVWCDSNEIESLDLSGNPALIILGCDRNKLTELKTDNNPKLASLWCSDNNLTELELSANPRLNDLWCFGNRITKLDLSANPLLVTLWCSDNELSTLDLSKNSDVAYLWCSSNKLTSLNLSGVKGLSVLVCHSNQIAGEEMTKVVNALPTLSPGAGAQSKFVVVDLKDTDEKNICTVKDVEKAKSKNWRVFDFNGDSDNMLPYEGSPTSNLAVDAPTVRIYPNPVGRYALVEIPESLLGQEAALYDMNGVKVYSFAVESLRQNIDLTHLPDGTYFFRLDNYTTKLIKQ

SEQ ID NO: 527 - protein, 310 aa, Porphyromonas gingivalis
MRKTIIFCLLLALFGCSWAQERVDEKVFSAGTSIFRGILEKVKAPLMYGDREVWGMARASEDFFFILPVTDDLTPVLFYNRLTNEPCFVSDQGITEYFKFAQEGDYIEVEGSSVFMANLLYYRFFPTRITSYNAPIEGVVSKTGNPAFTIPMLPGVSDCIEISNNRKVFLTNQLGVVNITDGMEPPIIAGVSASYGSSVRVYGHVSQRWDIIGHCYLDIYPTNCYPLSTKPVAGDDEVFVKQQGRQIEIDSNSPIVQVVVYDLEGKSVFRKRMTENAYTLSFRAPMLGFMTIMIETQNSIINKKLNVTQL

SEQ ID NO: 528 - protein, 405 aa, Porphyromonas gingivalis
MKKTTIISLIVFGAFFAAVGQTKDNSSYKPFSKEDIAGGVYSLPTQNRAQKDNAEWLLTATVSTNQSADTHFIFDENNRYIARDIKANGVRKSTDSIYYDANGRISHVDLYISFSGGEPALDTRFKYTYDDEGKMTVREVFMLVMDPNTPISRLEYHYDAQGRLTHWISFAFGAESQKNTYHYNEKGLLVSEVLSNAMGTTYSDTGKTEYSYDDADNMVKAEYFVVQQGKAWQVLKREEYTYEDNICIQYLAINGTDTKVYKRDIESDKSISANVIDIPSMPEQTWPNMYGFNAKRLKETYSSYEGDVATPIFDYIYTYKALTSMATPSTEAQVAVYLNPSTDRLVILANGITHLSMYDLQGKLIRDCALSGDKVEMGVGSLTKGTYLLKVNTDQGAFVRKVVIR

SEQ ID NO: 529 - DNA, 2037 bp, Porphyromonas gingivalis
gtaatggactacaaactcacttctcgattcaagcccacgggcgaccagccggaagccattcgccaactcgtacagggcatcaacgaagggatgccggctcagacgctgctcggcgtaacgggttcgggcaaaacttttacggtggctaacgtggtggcggcggtcaatcgtccgacccttgtcctgagtcacaacaagaccttggcagcacagctatacggagagttcaaagccttcttccccgagaatgcggtggagtatttcgtcagctactacgactactatcagcccgaggcctacctccccgtcacagacacctatatcgaaaaggacatggccatcaacgcggagatcgaaaaactgcgattgagggccacggcttcgctcctgtcagggcggaaagatgtgcttgtggtcagctccgtatcctgtctctacggtatggccaatcctgaagctttttccgaaaaggtgatcagcctgcacacgggacaaagggcagacagggatcattttatccgcctgctggtagagagctactacacgaacaataaagtagagttcgagagcggcaacttccgtgtcaaaggcgacagcgtggacatattccccgccgtagaaggttatgacggcgtggcatacagggtggagttttgggatggagaggtcgagcggctgagtaccttcgatccgcgaacgggacgggaatacggcctgctgtcggagctgaagatatatccggccaatctcttcgtgacgactaaggagcaggtggatcgggcagtagggaaaatcgatgtggatctgggcgcacaggtcgattttctgaaagaaatcggcaaaccatatgaagccaaacgcttgtatgagcgggtcacgtatgacttggaaatgatccgtgagttgggttattgttccggtatagagaactattcgcgctacttcgacggccgtgacgcgggcgaacgtcctttctgtctgttggattatttcccggaggatttcctgttggtcatagacgaaagccatgtaacgataccgcagatacgtgccatgtacggaggcgatcgttcgcgcaaggagaatctggtcgaatacggattccgcctgcctgccgctctcgacaatcggccgcttcgcttcgacgagttcgaagctctcaccccccggaccctttatatcagtgccacgcctgccgactatgagctgaacagaagcgaaggcgtgatcgtcgagcagctgatccgtccgaccggactgctggatcccatcatcgacgtcaagccgacggcaaaccaagtggacgatctgatggaggagatagcacgctgcatcgaaaagaaagagcgcgtactggtaacgaccctgaccaaacgtatggcagaggagcttagcgaatacctgctacgccacggtatcagcaccggctacatacacagcgatgtggacacgctggagcgtgtgcgtatcatggaagacctgcgcaagggggtctacgatgcactcatcggggtgaatctgctccgcgaaggattggacttgccggaagtttcgcttgtggctattctggatgcggataaggaaggattcctgcgctcgcatcgttcgctcacgcagactgcaggacgtgccgcccggcacattcatgggcgtgtcatcttctacgcggacaagatcaccgacagtatgcagctcaccatggacgagactgcacgccgacgcgcaaagcaactggcctacaacgaagcgcacggcatcaccccccaacagatagtgaagaacagtgctgccatttggggagaaggcgatgtgtcggccttgcaatccgatacagaatccggtgcgtacatagaagagagcagcatggtggctgccgatcctttggccgactatctgagcaaacccaagctggaagcactcattgcttcgaccaagaagcaaatgctggcagcagccaaagagctggactttctggaagcggcacgacttcgggacgaagccgcacgattggaaaagaaactggagcaactcacagcc

SEQ ID NO: 530 - DNA, 2034 bp, Porphyromonas gingivalis
atggactacaaactcacttctcgattcaagcccacgggcgaccagccggaagccattcgccaactcgtacagggcatcaacgaagggatgccggctcagacgctgctcggcgtaacgggttcgggcaaaacttttacggtggctaacgtggtggcggcggtcaatcgtccgacccttgtcctgagtcacaacaagaccttggcagcacagctatacggagagttcaaagccttcttccccgagaatgcggtggagtatttcgtcagctactacgactactatcagcccgaggcctacctccccgtcacagacacctatatcgaaaaggacatggccatcaacgcggagatcgaaaaactgcgattgagggccacggcttcgctcctgtcagggcggaaagatgtgcttgtggtcagctccgtatcctgtctctacggtatggccaatcctgaagctttttccgaaaaggtgatcagcctgcacacgggacaaagggcagacagggatcattttatccgcctgctggtagagagctactacacgaacaataaagtagagttcgagagcggcaacttccgtgtcaaaggcgacagcgtggacatattccccgccgtagaaggttatgacggcgtggcatacagggtggagttttgggatggagaggtcgagcggctgagtaccttcgatccgcgaacgggacgggaatacggcctgctgtcggagctgaagatatatccggccaatctcttcgtgacgactaaggagcaggtggatcgggcagtagggaaaatcgatgtggatctgggcgcacaggtcgattttctgaaagaaatcggcaaaccatatgaagccaaacgcttgtatgagcgggtcacgtatgacttggaaatgatccgtgagttgggttattgttccggtatagagaactattcgcgctacttcgacggccgtgacgcgggcgaacgtcctttctgtctgttggattatttcccggaggatttcctgttggtcatagacgaaagccatgtaacgataccgcagatacgtgccatgtacggaggcgatcgttcgcgcaaggagaatctggtcgaatacggattccgcctgcctgccgctctcgacaatcggccgcttcgcttcgacgagttcgaagctctcaccccccggaccctttatatcagtgccacgcctgccgactatgagctgaacagaagcgaaggcgtgatcgtcgagcagctgatccgtccgaccggactgctggatcccatcatcgacgtcaagccgacggcaaaccaagtggacgatctgatggaggagatagcacgctgcatcgaaaagaaagagcgcgtactggtaacgaccctgaccaaacgtatggcagaggagcttagcgaatacctgctacgccacggtatcagcaccggctacatacacagcgatgtggacacgctggagcgtgtgcgtatcatggaagacctgcgcaagggggtctacgatgcactcatcggggtgaatctgctccgcgaaggattggacttgccggaagtttcgcttgtggctattctggatgcggataaggaaggattcctgcgctcgcatcgttcgctcacgcagactgcaggacgtgccgcccggcacattcatgggcgtgtcatcttctacgcggacaagatcaccgacagtatgcagctcaccatggacgagactgcacgccgacgcgcaaagcaactggcctacaacgaagcgcacggcatcaccccccaacagatagtgaagaacagtgctgccatttggggagaaggcgatgtgtcggccttgcaatccgatacagaatccggtgcgtacatagaagagagcagcatggtggctgccgatcctttggccgactatctgagcaaacccaagctggaagcactcattgcttcgaccaagaagcaaatgctggcagcagccaaagagctggactttctggaagcggcacgacttcgggacgaagccgcacgattggaaaagaaactggagcaactcacagcc

SEQ ID NO: 531 - protein, 679 aa, Porphyromonas gingivalis
VMDYKLTSRFKPTGDQPEAIRQLVQGINEGMPAQTLLGVTGSGKTFTVANVVAAVNRPTLVLSHNKTLAAQLYGEFKAFFPENAVEYFVSYYDYYQPEAYLPVTDTYIEKDMAINAEIEKLRLRATASLLSGRKDVLVVSSVSCLYGMANPEAFSEKVISLHTGQRADRDHFIRLLVESYYTNNKVEFESGNFRVKGDSVDIFPAVEGYDGVAYRVEFWDGEVERLSTFDPRTGREYGLLSELKIYPANLFVTTKEQVDRAVGKIDVDLGAQVDFLKEIGKPYEAKRLYERVTYDLEMIRELGYCSGIENYSRYFDGRDAGERPFCLLDYFPEDFLLVIDESHVTIPQIRAMYGGDRSRKENLVEYGFRLPAALDNRPLRFDEFEALTPRTLYISATPADYELNRSEGVIVEQLIRPTGLLDPIIDVKPTANQVDDLMEEIARCIEKKERVLVTTLTKRMAEELSEYLLRHGISTGYIHSDVDTLERVRIMEDLRKGVYDALIGVNLLREGLDLPEVSLVAILDADKEGFLRSHRSLTQTAGRAARHIHGRVIFYADKITDSMQLTMDETARRRAKQLAYNEAHGITPQQIVKNSAAIWGEGDVSALQSDTESGAYIEESSMVAADPLADYLSKPKLEALIASTKKQMLAAAKELDFLEAARLRDEAARLEKKLEQLTA

SEQ ID NO: 532 - protein, 678 aa, Porphyromonas gingivalis
MDYKLTSRFKPTGDQPEAIRQLVQGINEGMPAQTLLGVTGSGKTFTVANVVAAVNRPTLVLSHNKTLAAQLYGEFKAFFPENAVEYFVSYYDYYQPEAYLPVTDTYIEKDMAINAEIEKLRLRATASLLSGRKDVLVVSSVSCLYGMANPEAFSEKVISLHTGQRADRDHFIRLLVESYYTNNKVEFESGNFRVKGDSVDIFPAVEGYDGVAYRVEFWDGEVERLSTFDPRTGREYGLLSELKIYPANLFVTTKEQVDRAVGKIDVDLGAQVDFLKEIGKPYEAKRLYERVTYDLEMIRELGYCSGIENYSRYFDGRDAGERPFCLLDYFPEDFLLVIDESHVTIPQIRAMYGGDRSRKENLVEYGFRLPAALDNRPLRFDEFEALTPRTLYISATPADYELNRSEGVIVEQLIRPTGLLDPIIDVKPTANQVDDLMEEIARCIEKKERVLVTTLTKRMAEELSEYLLRHGISTGYIHSDVDTLERVRIMEDLRKGVYDALIGVNLLREGLDLPEVSLVAILDADKEGFLRSHRSLTQTAGRAARHIHGRVIFYADKITDSMQLTMDETARRRAKQLAYNEAHGITPQQIVKNSAAIWGEGDVSALQSDTESGAYIEESSMVAADPLADYLSKPKLEALIASTKKQMLAAAKELDFLEAARLRDEAARLEKKLEQLTA

SEQ ID NO: 533 - DNA, 25 bp, Artificial Sequence
  Description of Artificial Sequence: Synthetic oligonucleotide
gcgccatatgctggccgaaccggcc

SEQ ID NO: 534 - DNA, 31 bp, Artificial Sequence
  Description of Artificial Sequence: Synthetic oligonucleotide
gcgcctcgagtcaattcatttccttatagag

SEQ ID NO: 535 - DNA, 26 bp, Artificial Sequence
  Description of Artificial Sequence: Synthetic oligonucleotide
cgcggtatacatgaaaagaatgacgc

SEQ ID NO: 536 - DNA, 28 bp, Artificial Sequence
  Description of Artificial Sequence: Synthetic oligonucleotide
cgcgagatctgaaagacaactgaatacc

SEQ ID NO: 537 - DNA, 29 bp, Artificial Sequence
  Description of Artificial Sequence: Synthetic oligonucleotide
gcgcgtatacatgaagaaatcaagtgtag

SEQ ID NO: 538 - DNA, 30 bp, Artificial Sequence
  Description of Artificial Sequence: Synthetic oligonucleotide
gcgcagatctcttcagcgtaccttgctgtg

SEQ ID NO: 539 - DNA, 33 bp, Artificial Sequence
  Description of Artificial Sequence: Synthetic oligonucleotide
cttctgtatacttacagcggacatcataaaatc

SEQ ID NO: 540 - DNA, 33 bp, Artificial Sequence
  Description of Artificial Sequence: Synthetic oligonucleotide
ttccaggagggtaccacgcaactcttcttcgat

SEQ ID NO: 541 - DNA, 30 bp, Artificial Sequence
  Description of Artificial Sequence: Synthetic oligonucleotide
ttgcaacatatgatcagaacgatactttca

SEQ ID NO: 542 - DNA, 30 bp, Artificial Sequence
  Description of Artificial Sequence: Synthetic oligonucleotide
agcaatctcgagcggttcatgagccaaagc

SEQ ID NO: 543 - DNA, 34 bp, Artificial Sequence
  Description of Artificial Sequence: Synthetic oligonucleotide
taaacatatgtgcctcgaacccataattgctccg

SEQ ID NO: 544 - DNA, 33 bp, Artificial Sequence
  Description of Artificial Sequence: Synthetic oligonucleotide
cgtccgcggaagctttgatcggccattgctact

SEQ ID NO: 545 - DNA, 28 bp, Artificial Sequence
  Description of Artificial Sequence: Synthetic oligonucleotide
cgcggtatacatggagttcaagattgtg

SEQ ID NO: 546 - DNA, 28 bp, Artificial Sequence
  Description of Artificial Sequence: Synthetic oligonucleotide
cgcgagatctgttttctgaaagcttttc

SEQ ID NO: 547 - DNA, 28 bp, Artificial Sequence
  Description of Artificial Sequence: Synthetic oligonucleotide
cgcggtatacatggaaaacttaaagaac

SEQ ID NO: 548 - DNA, 28 bp, Artificial Sequence
  Description of Artificial Sequence: Synthetic oligonucleotide
cgcgagatctgttttctgaaagcttttc

SEQ ID NO: 549 - DNA, 30 bp, Artificial Sequence
  Description of Artificial Sequence: Synthetic oligonucleotide
cgcggatatcatggataaagtgagctatgc

SEQ ID NO: 550 - DNA, 31 bp, Artificial Sequence
  Description of Artificial Sequence: Synthetic oligonucleotide
cgcgagatcttttgttgatactcaataattc

SEQ ID NO: 551 - DNA, 41 bp, Artificial Sequence
  Description of Artificial Sequence: Synthetic oligonucleotide
gcgcgtatacatgagagcaaacatttggcagatactttccg

SEQ ID NO: 552 - DNA, 31 bp, Artificial Sequence
  Description of Artificial Sequence: Synthetic oligonucleotide
gcgcagatctgcgcaagcgcagtatatcgcc

SEQ ID NO: 553 - DNA, 48 bp, Artificial Sequence
  Description of Artificial Sequence: Synthetic oligonucleotide
gcgcgtatacatgaatagcagacatctgacaatcacaatcattgccgg

SEQ ID NO: 554 - DNA, 39 bp, Artificial Sequence
  Description of Artificial Sequence: Synthetic oligonucleotide
gcgcagatctgctgttctgtgagtgcagttgtttaagtg

SEQ ID NO: 555 - DNA, 34 bp, Artificial Sequence
  Description of Artificial Sequence: Synthetic oligonucleotide
gcgccatatgcggacaaaaactatcttttttgcg

SEQ ID NO: 556 - DNA, 37 bp, Artificial Sequence
  Description of Artificial Sequence: Synthetic oligonucleotide
gcgcctcgaggttgttgaatcgaatcgctatttgagc

SEQ ID NO: 557 - DNA, 38 bp, Artificial Sequence
  Description of Artificial Sequence: Synthetic oligonucleotide
gcgcggcgccatgacggacaacaaacaacgtaatatcg

SEQ ID NO: 558 - DNA, 38 bp, Artificial Sequence
  Description of Artificial Sequence: Synthetic oligonucleotide
gcgcctcgagttacttgcgtatgatcacggacataccc

SEQ ID NO: 559 - DNA, 30 bp, Artificial Sequence
  Description of Artificial Sequence: Synthetic oligonucleotide
caaaagtatactaataaatatcattctcaa

SEQ ID NO: 560 - DNA, 30 bp, Artificial Sequence
  Description of Artificial Sequence: Synthetic oligonucleotide
gcttatggtacctttggtcttatctattat

SEQ ID NO: 561 - DNA, 28 bp, Artificial Sequence
  Description of Artificial Sequence: Synthetic oligonucleotide
ccccggatccgatgcgactgatcaaggc

SEQ ID NO: 562 - DNA, 28 bp, Artificial Sequence
  Description of Artificial Sequence: Synthetic oligonucleotide
ccccctcgagcggaacggggtcatagcc

SEQ ID NO: 563 - DNA, 29 bp, Artificial Sequence
  Description of Artificial Sequence: Synthetic oligonucleotide
cgcggtatacatgaattacctgtacatac

SEQ ID NO: 564 - DNA, 30 bp, Artificial Sequence
  Description of Artificial Sequence: Synthetic oligonucleotide
cgcgggatccgttcgattggtcgtcgatgg

SEQ ID NO: 565 - DNA, 31 bp, Artificial Sequence
  Description of Artificial Sequence: Synthetic oligonucleotide
cgcgcatatggagattgctttcctttcttcg

SEQ ID NO: 566 - DNA, 29 bp, Artificial Sequence
  Description of Artificial Sequence: Synthetic oligonucleotide
cgcgctcgagttagttcgattggtcgtcg

SEQ ID NO: 567 - DNA, 34 bp, Artificial Sequence
  Description of Artificial Sequence: Synthetic oligonucleotide
gcgcgatatcgctagcatgaaaaagctatttctc

SEQ ID NO: 568 - DNA, 38 bp, Artificial Sequence
  Description of Artificial Sequence: Synthetic oligonucleotide
gcgcagatctctcgagtttgccatcggattgcggattg

SEQ ID NO: 569 - DNA, 34 bp, Artificial Sequence
  Description of Artificial Sequence: Synthetic oligonucleotide
tacggaattcgtgacccccgtcagaaatgtgcgc

SEQ ID NO: 570 - DNA, 36 bp, Artificial Sequence
  Description of Artificial Sequence: Synthetic oligonucleotide
ctatgcggccgctttgatcctcaaggctttgcccgg

SEQ ID NO: 571 - DNA, 34 bp, Artificial Sequence
  Description of Artificial Sequence: Synthetic oligonucleotide
cggggaattcgcaaaaatcaatttctatgctgaa

SEQ ID NO: 572 - DNA, 36 bp, Artificial Sequence
  Description of Artificial Sequence: Synthetic oligonucleotide
ctatgcggccgctgtatgcaatagggaaagctccga

SEQ ID NO: 573 - DNA, 34 bp, Artificial Sequence
  Description of Artificial Sequence: Synthetic oligonucleotide
cgcagaattccaggagaatactgtaccggcaacg

SEQ ID NO: 574 - DNA, 35 bp, Artificial Sequence
  Description of Artificial Sequence: Synthetic oligonucleotide
ctatgcggccgccttggagcgaacgattacaacac

SEQ ID NO: 575 - DNA, 34 bp, Artificial Sequence
  Description of Artificial Sequence: Synthetic oligonucleotide
tgcagaattccaagaagctactacacagaacaaa

SEQ ID NO: 576 - DNA, 35 bp, Artificial Sequence
  Description of Artificial Sequence: Synthetic oligonucleotide
ctatgcggccgcttccgctgcagtcattactacaa

SEQ ID NO: 577 - DNA, 34 bp, Artificial Sequence
  Description of Artificial Sequence: Synthetic oligonucleotide
gcgcgaattcatgaaacaactaaacattatcagc

SEQ ID NO: 578 - DNA, 35 bp, Artificial Sequence
  Description of Artificial Sequence: Synthetic oligonucleotide
gcgtgcggccgcgaaattgatctttgtaccgacga

SEQ ID NO: 579 - DNA, 34 bp, Artificial Sequence
  Description of Artificial Sequence: Synthetic oligonucleotide
aaaggaattctacaaaaagattattgccgtagca

SEQ ID NO: 580 - DNA, 35 bp, Artificial Sequence
  Description of Artificial Sequence: Synthetic oligonucleotide
ctatgcggccgcgaactcctgtccgagcacaaagt

SEQ ID NO: 581 - DNA, 34 bp, Artificial Sequence
  Description of Artificial Sequence: Synthetic oligonucleotide
tggcgaattcaaacggtttttgattttgatcggc

SEQ ID NO: 582 - DNA, 36 bp, Artificial Sequence
  Description of Artificial Sequence: Synthetic oligonucleotide
ctatgcggccgccttgctaaagcccatcttgctcag

SEQ ID NO: 583 - DNA, 34 bp, Artificial Sequence
  Description of Artificial Sequence: Synthetic oligonucleotide
cctcgaattccaaaaggtggcagtggtaaacact

SEQ ID NO: 584 - DNA, 36 bp, Artificial Sequence
  Description of Artificial Sequence: Synthetic oligonucleotide
ctatgcggccgccttgattccgagtttcgcttttac

SEQ ID NO: 585 - DNA, 34 bp, Artificial Sequence
  Description of Artificial Sequence: Synthetic oligonucleotide
agctggatcccaaggcgtcagggtatcgggctat

SEQ ID NO: 586 - DNA, 35 bp, Artificial Sequence
  Description of Artificial Sequence: Synthetic oligonucleotide
ctatgcggccgcgaattcgacgaggagacgcaggt

SEQ ID NO: 587 - DNA, 34 bp, Artificial Sequence
  Description of Artificial Sequence: Synthetic oligonucleotide
ggctgaattcaagacggacaacgtcccgacagat

SEQ ID NO: 588 - DNA, 35 bp, Artificial Sequence
  Description of Artificial Sequence: Synthetic oligonucleotide
ctatgcggccgcgaagttgaccataaccttaccca

SEQ ID NO: 589 - DNA, 34 bp, Artificial Sequence
  Description of Artificial Sequence: Synthetic oligonucleotide
gactgaattccaaaacgcctccgaaacgacggta

SEQ ID NO: 590 - DNA, 36 bp, Artificial Sequence
  Description of Artificial Sequence: Synthetic oligonucleotide
ctatgcggccgcttgttcgggaatccccatgccgtt

SEQ ID NO: 591 - DNA, 34 bp, Artificial Sequence
  Description of Artificial Sequence: Synthetic oligonucleotide
gtttgaattcgcaaataatactcttttggcgaag

SEQ ID NO: 592 - DNA, 37 bp, Artificial Sequence
  Description of Artificial Sequence: Synthetic oligonucleotide
gagtgcggccgctttgccggacatcgaagagatcgtc

SEQ ID NO: 593 - DNA, 34 bp, Artificial Sequence
  Description of Artificial Sequence: Synthetic oligonucleotide
gcgcgaattcaaaaaagaaaaactttggattgcg

SEQ ID NO: 594 - DNA, 36 bp, Artificial Sequence
  Description of Artificial Sequence: Synthetic oligonucleotide
ctatgcggccgccttcaaagcgaaagaagccttaac

SEQ ID NO: 595 - DNA, 34 bp, Artificial Sequence
  Description of Artificial Sequence: Synthetic oligonucleotide
agccgaattctgtaagaaaaatgctgacactacc

SEQ ID NO: 596 - DNA, 36 bp, Artificial Sequence
  Description of Artificial Sequence: Synthetic oligonucleotide
ctatgcggccgcctttttcccgggcttgatcccgat

SEQ ID NO: 597 - DNA, 34 bp, Artificial Sequence
  Description of Artificial Sequence: Synthetic oligonucleotide
gacaggatcctgctccaccacaaagaatctgccg

SEQ ID NO: 598 - DNA, 35 bp, Artificial Sequence
  Description of Artificial Sequence: Synthetic oligonucleotide
ctatgcggccgcgaagggatagccgacagccaaat

SEQ ID NO: 599 - DNA, 34 bp, Artificial Sequence
  Description of Artificial Sequence: Synthetic oligonucleotide
ctcggaattccgttatgtgccggacggtagcaga

SEQ ID NO: 600 - DNA, 35 bp, Artificial Sequence
  Description of Artificial Sequence: Synthetic oligonucleotide
ctatgcggccgcgaacggatagcctactgcaatgt

SEQ ID NO: 601 - DNA, 46 bp, Artificial Sequence
  Description of Artificial Sequence: Synthetic oligonucleotide
cgccgaattccaaacagtggtgaccggtaaggtgatcgattcagaa

SEQ ID NO: 602 - DNA, 48 bp, Artificial Sequence
  Description of Artificial Sequence: Synthetic oligonucleotide
ctatgcggccgcgaagtttacacgaataccggtagaccaagtgcggcc

SEQ ID NO: 603 - DNA, 34 bp, Artificial Sequence
  Description of Artificial Sequence: Synthetic oligonucleotide
tgctgaattccaaaaatccaagcaggtacagcga

SEQ ID NO: 604 - DNA, 36 bp, Artificial Sequence
  Description of Artificial Sequence: Synthetic oligonucleotide
ctatgcggccgctcgtaaccatagtcttgggttttg

SEQ ID NO: 605 - DNA, 34 bp, Artificial Sequence
  Description of Artificial Sequence: Synthetic oligonucleotide
gaacggatccaacgagccggtggaagacagatcc

SEQ ID NO: 606 - DNA, 37 bp, Artificial Sequence
  Description of Artificial Sequence: Synthetic oligonucleotide
gagtgcggccgctaatctcgacttcatacttgtacca

SEQ ID NO: 607 - DNA, 34 bp, Artificial Sequence
  Description of Artificial Sequence: Synthetic oligonucleotide
gctgggatccgcgacagacactgagttcaagtac

SEQ ID NO: 608 - DNA, 35 bp, Artificial Sequence
  Description of Artificial Sequence: Synthetic oligonucleotide
ctatgcggccgcgaacttcactaccaagcccatgt

SEQ ID NO: 609 - DNA, 34 bp, Artificial Sequence
  Description of Artificial Sequence: Synthetic oligonucleotide
tcttgaattcgcgcaaagtcttttcagcaccgaa

SEQ ID NO: 610 - DNA, 36 bp, Artificial Sequence
  Description of Artificial Sequence: Synthetic oligonucleotide
ctatgcggccgcactttttcgtgggatcactctctt

SEQ ID NO: 611 - DNA, 34 bp, Artificial Sequence
  Description of Artificial Sequence: Synthetic oligonucleotide
agaagaattcaaacggacaatcctcctgacggca

SEQ ID NO: 612 - DNA, 36 bp, Artificial Sequence
  Description of Artificial Sequence: Synthetic oligonucleotide
ctatgcggccgcgaagtctttgccctgatagaaatc

SEQ ID NO: 613 - DNA, 34 bp, Artificial Sequence
  Description of Artificial Sequence: Synthetic oligonucleotide
ggctgaattcgcgaatccccttacgggccaatcg

SEQ ID NO: 614 - DNA, 35 bp, Artificial Sequence
  Description of Artificial Sequence: Synthetic oligonucleotide
ctatgcggccgcgtccgaaaggcagccgtaatagg

SEQ ID NO: 615 - DNA, 34 bp, Artificial Sequence
  Description of Artificial Sequence: Synthetic oligonucleotide
cgctgaattccagatttcgttcggaggggaaccc

SEQ ID NO: 616 - DNA, 35 bp, Artificial Sequence
  Description of Artificial Sequence: Synthetic oligonucleotide
ctatgcggccgcctgcttcacgatcttttggctca

SEQ ID NO: 617 - DNA, 34 bp, Artificial Sequence
  Description of Artificial Sequence: Synthetic oligonucleotide
cgagggatccgagctctctatttgcgatggcgag

SEQ ID NO: 618 - DNA, 37 bp, Artificial Sequence
  Description of Artificial Sequence: Synthetic oligonucleotide
gagtgcggccgctcttacctgacttcttgtcacgaat

SEQ ID NO: 619 - DNA, 34 bp, Artificial Sequence
  Description of Artificial Sequence: Synthetic oligonucleotide
aaatggatcccgaaaaattttgagctttttgatg

SEQ ID NO: 620 - DNA, 36 bp, Artificial Sequence
  Description of Artificial Sequence: Synthetic oligonucleotide
ctatgcggccgctttgattcgtaatttttccgtatc

SEQ ID NO: 621 - DNA, 34 bp, Artificial Sequence
  Description of Artificial Sequence: Synthetic oligonucleotide
tgctggatcccaagagatctcaggcatgaatgca

SEQ ID NO: 622 - DNA, 37 bp, Artificial Sequence
  Description of Artificial Sequence: Synthetic oligonucleotide
gagtgcggccgctcggcctctttatctctaccttttc

SEQ ID NO: 623 - DNA, 34 bp, Artificial Sequence
  Description of Artificial Sequence: Synthetic oligonucleotide
cggtgaattccaaaccccacgaaatacagaaacc

SEQ ID NO: 624 - DNA, 37 bp, Artificial Sequence
  Description of Artificial Sequence: Synthetic oligonucleotide
gagtgcggccgctgaaagtccagctaaaaccggcgaa

SEQ ID NO: 625 - DNA, 34 bp, Artificial Sequence
  Description of Artificial Sequence: Synthetic oligonucleotide
tgctgaattccaacaagagaagcaggtgtttcat

SEQ ID NO: 626 - DNA, 37 bp, Artificial Sequence
  Description of Artificial Sequence: Synthetic oligonucleotide
gagtgcggccgctgaagatgctcttatcgtccaaacg

SEQ ID NO: 627 - DNA, 34 bp, Artificial Sequence
  Description of Artificial Sequence: Synthetic oligonucleotide
ggcggaattccagatgctcaatactcctttcgag

SEQ ID NO: 628 - DNA, 37 bp, Artificial Sequence
  Description of Artificial Sequence: Synthetic oligonucleotide
gagtgcggccgctgaagaggtaggagatattgcagat

SEQ ID NO: 629 - DNA, 34 bp, Artificial Sequence
  Description of Artificial Sequence: Synthetic oligonucleotide
agcagaattccccgtctccaacagcgagatagat

SEQ ID NO: 630 - DNA, 37 bp, Artificial Sequence
  Description of Artificial Sequence: Synthetic oligonucleotide
gagtgcggccgctgaaatcgattgtcagactacccag

SEQ ID NO: 631 - DNA, 34 bp, Artificial Sequence
  Description of Artificial Sequence: Synthetic oligonucleotide
tgctgaattccagcggtttccgatggtgcaggga

SEQ ID NO: 632 - DNA, 37 bp, Artificial Sequence
  Description of Artificial Sequence: Synthetic oligonucleotide
gagtgcggccgctgaagtgaaatccgacacgcagctg

SEQ ID NO: 633 - DNA, 34 bp, Artificial Sequence
  Description of Artificial Sequence: Synthetic oligonucleotide
ggcagaattccaagaagcaaacactgcatctgac

SEQ ID NO: 634 - DNA, 37 bp, Artificial Sequence
  Description of Artificial Sequence: Synthetic oligonucleotide
gagtgcggccgctgaaagtgtacgcaacacccacgcc

SEQ ID NO: 635 - DNA, 34 bp, Artificial Sequence
  Description of Artificial Sequence: Synthetic oligonucleotide
tgctgaattccagagtcgtcctgctcttagactg

SEQ ID NO: 636 - DNA, 37 bp, Artificial Sequence
  Description of Artificial Sequence: Synthetic oligonucleotide
gagtgcggccgctgaagcgaacaccgagacccacaaa

SEQ ID NO: 637 - DNA, 34 bp, Artificial Sequence
  Description of Artificial Sequence: Synthetic oligonucleotide
ggccggatccatcggacaaagccgcccggcactt

SEQ ID NO: 638 - DNA, 37 bp, Artificial Sequence
  Description of Artificial Sequence: Synthetic oligonucleotide
gagtgcggccgctaaagcggtaacctatgcccacgaa

SEQ ID NO: 639 - DNA, 34 bp, Artificial Sequence
  Description of Artificial Sequence: Synthetic oligonucleotide
gtttgaattccaagacgttatcagaccatggtca

SEQ ID NO: 640 - DNA, 37 bp, Artificial Sequence
  Description of Artificial Sequence: Synthetic oligonucleotide
gagtgcggccgctaaaatgagtggagagcgtggccat

SEQ ID NO: 641 - DNA, 34 bp, Artificial Sequence
  Description of Artificial Sequence: Synthetic oligonucleotide
gaacgagctcgcggaacgtcctatggccggagca

SEQ ID NO: 642 - DNA, 37 bp, Artificial Sequence
  Description of Artificial Sequence: Synthetic oligonucleotide
gagtgcggccgctataccaagtattcgtgatgggacg

SEQ ID NO: 643 - DNA, 33 bp, Artificial Sequence
  Description of Artificial Sequence: Synthetic oligonucleotide
gcttgcggccgcccttatgaaagatttgcagat

SEQ ID NO: 644 - DNA, 35 bp, Artificial Sequence
  Description of Artificial Sequence: Synthetic oligonucleotide
ggtgctcgagtatactcaacaagcaccttatgcac

SEQ ID NO: 645 - DNA, 34 bp, Artificial Sequence
  Description of Artificial Sequence: Synthetic oligonucleotide
tgctgaattccaggaaggggaggggagtgcccga

SEQ ID NO: 646 - DNA, 37 bp, Artificial Sequence
  Description of Artificial Sequence: Synthetic oligonucleotide
gagtgcggccgctgaagctgtagcgggctttgaacca

SEQ ID NO: 647 - DNA, 34 bp, Artificial Sequence
  Description of Artificial Sequence: Synthetic oligonucleotide
cggtggatcctcgcaaatgctcttctcagagaat

SEQ ID NO: 648 - DNA, 37 bp, Artificial Sequence
  Description of Artificial Sequence: Synthetic oligonucleotide
gagtgcggccgctaaacgaaatatcgataccaacatc

SEQ ID NO: 649 - DNA, 34 bp, Artificial Sequence
  Description of Artificial Sequence: Synthetic oligonucleotide
tgctgaattccagaacaataccctcgatgtacac

SEQ ID NO: 650 - DNA, 37 bp, Artificial Sequence
  Description of Artificial Sequence: Synthetic oligonucleotide
gagtgcggccgctattgccggtaggatttccttgtcc

SEQ ID NO: 651 - DNA, 34 bp, Artificial Sequence
  Description of Artificial Sequence: Synthetic oligonucleotide
tgctgaattcggagagcgactggagacggacagc

SEQ ID NO: 652 - DNA, 37 bp, Artificial Sequence
  Description of Artificial Sequence: Synthetic oligonucleotide
gagtgcggccgctatgattgcctttcagaaaagctat

SEQ ID NO: 653 - DNA, 34 bp, Artificial Sequence; identical to SEQ ID NO: 651
  Description of Artificial Sequence: Synthetic oligonucleotide

SEQ ID NO: 654 - DNA, 34 bp, Artificial Sequence
  Description of Artificial Sequence: Synthetic oligonucleotide
cggtgaattccaacagacaggaccggccgaacgc

SEQ ID NO: 655 - DNA, 37 bp, Artificial Sequence
  Description of Artificial Sequence: Synthetic oligonucleotide
gagtgcggccgcttaagaaaggtatctgatagatcag

SEQ ID NO: 656 - DNA, 34 bp, Artificial Sequence
  Description of Artificial Sequence: Synthetic oligonucleotide
tgctgaattccaagaaaataatacagaaaagtca

SEQ ID NO: 657 - DNA, 37 bp, Artificial Sequence
  Description of Artificial Sequence: Synthetic oligonucleotide
gagtgcggccgctgaggtttaatcctatgccaatact

SEQ ID NO: 658 - DNA, 34 bp, Artificial Sequence
  Description of Artificial Sequence: Synthetic oligonucleotide
ggcgggatccgctcaggagcaactgaatgtggta

SEQ ID NO: 659 - DNA, 37 bp, Artificial Sequence
  Description of Artificial Sequence: Synthetic oligonucleotide
gagtgcggccgctgtggaacaaattgcgcaatccatc

SEQ ID NO: 660 - DNA, 34 bp, Artificial Sequence
  Description of Artificial Sequence: Synthetic oligonucleotide
agcagaattcggaaacgcacagagcttttgggaa

SEQ ID NO: 661 - DNA, 37 bp, Artificial Sequence
  Description of Artificial Sequence: Synthetic oligonucleotide
gagtgcggccgcttacctgcaccttatgactgaatac

SEQ ID NO: 662 - DNA, 34 bp, Artificial Sequence
  Description of Artificial Sequence: Synthetic oligonucleotide
tgctgaattccaagagaaaaaggatagtctctct

SEQ ID NO: 663 - DNA, 37 bp, Artificial Sequence
  Description of Artificial Sequence: Synthetic oligonucleotide
gagtgcggccgctcttcttatcgccatagaatacagg

SEQ ID NO: 664 - DNA, 34 bp, Artificial Sequence
  Description of Artificial Sequence: Synthetic oligonucleotide
ggcagaattccaggattcttcccacggtagcaat

SEQ ID NO: 665 - DNA, 37 bp, Artificial Sequence
  Description of Artificial Sequence: Synthetic oligonucleotide
gagtgcggccgctatcatgatagtaaagactggttct

SEQ ID NO: 666 - DNA, 34 bp, Artificial Sequence
  Description of Artificial Sequence: Synthetic oligonucleotide
tgctgaattcgtagtgacgctgctcgtaattgtc

SEQ ID NO: 667 - DNA, 37 bp, Artificial Sequence
  Description of Artificial Sequence: Synthetic oligonucleotide
gagtgcggccgctgccgtcctgcctttctgcctgacg

SEQ ID NO: 668 - DNA, 34 bp, Artificial Sequence
  Description of Artificial Sequence: Synthetic oligonucleotide
ggccgaattccaaaacgtgcagttgcactacgat

SEQ ID NO: 669 - DNA, 37 bp, Artificial Sequence
  Description of Artificial Sequence: Synthetic oligonucleotide
gagtgcggccgctgttgaaagtccatttgaccgcaag

SEQ ID NO: 670 - DNA, 34 bp, Artificial Sequence
  Description of Artificial Sequence: Synthetic oligonucleotide
gtttgaattccaggattttctctatgaaatagga

SEQ ID NO: 671 - DNA, 37 bp, Artificial Sequence
  Description of Artificial Sequence: Synthetic oligonucleotide
gagtgcggccgctttgtttattacaaaaagtcttacg

SEQ ID NO: 672 - DNA, 34 bp, Artificial Sequence
  Description of Artificial Sequence: Synthetic oligonucleotide
gaacgaattccagaacaacaactttaccgagtcg

SEQ ID NO: 673 - DNA, 37 bp, Artificial Sequence
  Description of Artificial Sequence: Synthetic oligonucleotide
gagtgcggccgctgttcagtttcagctttttaaacca

SEQ ID NO: 674 - DNA, 34 bp, Artificial Sequence
  Description of Artificial Sequence: Synthetic oligonucleotide
tgctggatcccagaatgatgacatcttcgaagat

SEQ ID NO: 675 - DNA, 37 bp, Artificial Sequence
  Description of Artificial Sequence: Synthetic oligonucleotide
gagtgcggccgctattgcgtccccggccactacgtcc

SEQ ID NO: 676 - DNA, 34 bp, Artificial Sequence
  Description of Artificial Sequence: Synthetic oligonucleotide
cggtgaattcgtaccaacggacagcacggaatcg

SEQ ID NO: 677 - DNA, 37 bp, Artificial Sequence
  Description of Artificial Sequence: Synthetic oligonucleotide
gagtgcggccgctcagattggtgctataagaaaggta

SEQ ID NO: 678 - DNA, 34 bp, Artificial Sequence
  Description of Artificial Sequence: Synthetic oligonucleotide
tgctggatcccaaacgcatgatcatctcatcgaa

SEQ ID NO: 679 - DNA, 37 bp, Artificial Sequence
  Description of Artificial Sequence: Synthetic oligonucleotide
gagtgcggccgctgtggttcaggccgtgggcaaatct

SEQ ID NO: 680 - DNA, 34 bp, Artificial Sequence
  Description of Artificial Sequence: Synthetic oligonucleotide
ggcggaattccagagctatgtggactacgtcgat

SEQ ID NO: 681 - DNA, 37 bp, Artificial Sequence
  Description of Artificial Sequence: Synthetic oligonucleotide
gagtgcggccgctattactgtgattagcgcgacgctg

SEQ ID NO: 682 - DNA, 34 bp, Artificial Sequence
  Description of Artificial Sequence: Synthetic oligonucleotide
agcagaattcgccgaatcgaagtctgtctctttc

SEQ ID NO: 683 - DNA, 37 bp, Artificial Sequence
  Description of Artificial Sequence: Synthetic oligonucleotide
gagtgcggccgctcggcaagtaacgctttagtgggga

SEQ ID NO: 684 - DNA, 34 bp, Artificial Sequence
  Description of Artificial Sequence: Synthetic oligonucleotide
tgctgaattccaatcgaagttaaagatcaagagc

SEQ ID NO: 685 - DNA, 37 bp, Artificial Sequence
  Description of Artificial Sequence: Synthetic oligonucleotide
gagtgcggccgctattagtccaaagacccacggtaaa

SEQ ID NO: 686 - DNA, 34 bp, Artificial Sequence
  Description of Artificial Sequence: Synthetic oligonucleotide
ggcagaattccaaacaacgacgaacagtagccgg

SEQ ID NO: 687 - DNA, 37 bp, Artificial Sequence
  Description of Artificial Sequence: Synthetic oligonucleotide
gagtgcggccgcttttttgttgtgatactgtttgggc

SEQ ID NO: 688 - DNA, 34 bp, Artificial Sequence
  Description of Artificial Sequence: Synthetic oligonucleotide
tgctgaattccagacgatgggaggagatgatgtc

SEQ ID NO: 689 - DNA, 37 bp, Artificial Sequence
  Description of Artificial Sequence: Synthetic oligonucleotide
gagtgcggccgctttccacgatgagcttctctacgaa

SEQ ID NO: 690 - DNA, 34 bp, Artificial Sequence
  Description of Artificial Sequence: Synthetic oligonucleotide
ggccgaattcgccgatgcacaaagctctgtctct

SEQ ID NO: 691 - DNA, 37 bp, Artificial Sequence
  Description of Artificial Sequence: Synthetic oligonucleotide
gagtgcggccgcttcgaggacgattgcttagttcgta

SEQ ID NO: 692 - DNA, 34 bp, Artificial Sequence
  Description of Artificial Sequence: Synthetic oligonucleotide
ggccgagctccaagaggaaggtatttggaatacc

SEQ ID NO: 693 - DNA, 37 bp, Artificial Sequence
  Description of Artificial Sequence: Synthetic oligonucleotide
gagtgcggccgctgcgaatcactgcgaagcgaattag

SEQ ID NO: 694 - DNA, 34 bp, Artificial Sequence; identical to SEQ ID NO: 692
  Description of Artificial Sequence: Synthetic oligonucleotide

SEQ ID NO: 695 - DNA, 37 bp, Artificial Sequence
  Description of Artificial Sequence: Synthetic oligonucleotide
gagtgcggccgctttgtcctaccacgatcattttctt

SEQ ID NO: 696 - DNA, 34 bp, Artificial Sequence
  Description of Artificial Sequence: Synthetic oligonucleotide
ggccgagctctgtggaaaaaaagaaaaacactct

SEQ ID NO: 697 - DNA, 37 bp, Artificial Sequence
  Description of Artificial Sequence: Synthetic oligonucleotide
gagtgcggccgctaactgtctccttgtcgctccccgg

SEQ ID NO: 698 - DNA, 34 bp, Artificial Sequence
  Description of Artificial Sequence: Synthetic oligonucleotide
tgctgagctccaaacgcaaatgcaagcagaccga

SEQ ID NO: 699 - DNA, 37 bp, Artificial Sequence
  Description of Artificial Sequence: Synthetic oligonucleotide
gagtgcggccgcttttgagaattttcattgtctcacg

SEQ ID NO: 700 - DNA, 34 bp, Artificial Sequence
  Description of Artificial Sequence: Synthetic oligonucleotide
ggcgggatcccagtttgttccggctcccaccaca

SEQ ID NO: 701 - DNA, 37 bp, Artificial Sequence
  Description of Artificial Sequence: Synthetic oligonucleotide
gagtgcggccgctctgtttgatgagcttagtggtata

SEQ ID NO: 702 - DNA, 34 bp, Artificial Sequence
  Description of Artificial Sequence: Synthetic oligonucleotide
agcagaattccaagaaagagtcgatgaaaaagta

SEQ ID NO: 703 - DNA, 43 bp, Artificial Sequence
  Description of Artificial Sequence: Synthetic oligonucleotide
gagtgcggccgcttagctgtgtaacattaagttttttattgat

SEQ ID NO: 704 - DNA, 34 bp, Artificial Sequence
  Description of Artificial Sequence: Synthetic oligonucleotide
tgctgaattcaaggacaattcttcttacaaacct

SEQ ID NO: 705 - DNA, 37 bp, Artificial Sequence
  Description of Artificial Sequence: Synthetic oligonucleotide
gagtgcggccgcttcgaatcacgacttttctcacaaa

SEQ ID NO: 706 - DNA, 34 bp, Artificial Sequence
  Description of Artificial Sequence: Synthetic oligonucleotide
ggcagaattccagtctttgagcacaatcaaagta

SEQ ID NO: 707 - DNA, 37 bp, Artificial Sequence
  Description of Artificial Sequence: Synthetic oligonucleotide
gagtgcggccgctgatagccagcttgatgctcttagc

SEQ ID NO: 708 - DNA, 34 bp, Artificial Sequence
  Description of Artificial Sequence: Synthetic oligonucleotide
tgctgaattcaaaggcaagggcgatctggtcggg

SEQ ID NO: 709 - DNA, 37 bp, Artificial Sequence
  Description of Artificial Sequence: Synthetic oligonucleotide
gagtgcggccgcttctcttctcgaacttggccgagta

SEQ ID NO: 710 - DNA, 34 bp, Artificial Sequence
  Description of Artificial Sequence: Synthetic oligonucleotide
ggccgaattccagatggatattggtggagacgat

SEQ ID NO: 711 - DNA, 37 bp, Artificial Sequence
  Description of Artificial Sequence: Synthetic oligonucleotide
gagtgcggccgctctctacaatgattttttccacgaa

SEQ ID NO: 712 - DNA, 34 bp, Artificial Sequence
  Description of Artificial Sequence: Synthetic oligonucleotide
gaacggatccaacgtgtctgctcagtcaccccga

SEQ ID NO: 713 - DNA, 37 bp, Artificial Sequence
  Description of Artificial Sequence: Synthetic oligonucleotide
gagtgcggccgcttctgagcgatacttttgcacgtat

SEQ ID NO: 714 - DNA, 28 bp, Artificial Sequence
  Description of Artificial Sequence: Synthetic oligonucleotide
gcgcctcgagattcatttccttatagag

SEQ ID NO: 715 - DNA, 33 bp, Artificial Sequence
  Description of Artificial Sequence: Synthetic oligonucleotide
cttcttgtcgactacagcggacatcataaaatc

SEQ ID NO: 716 - DNA, 33 bp, Artificial Sequence
  Description of Artificial Sequence: Synthetic oligonucleotide
ttccacctcgagttaacgcaactcttcttcgat

SEQ ID NO: 717 - DNA, 34 bp, Artificial Sequence
  Description of Artificial Sequence: Synthetic oligonucleotide
taaagaattctgcctcgaacccataattgctccg

SEQ ID NO: 718 - DNA, 27 bp, Artificial Sequence
  Description of Artificial Sequence: Synthetic oligonucleotide
cgcgcatatggataaagtgagctatgc

SEQ ID NO: 719 - DNA, 31 bp, Artificial Sequence
  Description of Artificial Sequence: Synthetic oligonucleotide
cgcgctcgagtttgttgatactcaataattc

SEQ ID NO: 720 - DNA, 37 bp, Artificial Sequence
  Description of Artificial Sequence: Synthetic oligonucleotide
gcccggcgccatgcggacaaaaactatcttttttgcg

SEQ ID NO: 721 - DNA, 40 bp, Artificial Sequence
  Description of Artificial Sequence: Synthetic oligonucleotide
gcccggcgccttagttgttgaatcgaatcgctatttgagc

The invention claimed is:

1. An isolated antigenic *Porphorymonas gingivalis* polypeptide, the polypeptide having the sequence SEQ ID NO: 426.

2. A composition for use in raising an immune response directed against *P. gingivalis* in a subject, the composition comprising an effective amount of the polypeptide as claimed in claim 1 and a pharmaceutically acceptable carrier.

3. A composition as claimed in claim 2 in which the pharmaceutically acceptable carrier is an adjuvant.

\* \* \* \* \*